US009340590B2

(12) United States Patent
Murray et al.

(10) Patent No.: US 9,340,590 B2

(45) Date of Patent: May 17, 2016

(54) POTENT AND SELECTIVE INHIBITORS OF $NA_V1.3$ AND $NA_V1.7$

(75) Inventors: Justin K. Murray, Moorpark, CA (US); Leslie P. Miranda, Thousand Oaks, CA (US); Stefan I. McDonough, San Francisco, CA (US)

(73) Assignee: AMGEN INC., Thousand Oaks, CA (US)

(*) Notice: Subject to any disclaimer, the term of this patent is extended or adjusted under 35 U.S.C. 154(b) by 0 days.

(21) Appl. No.: 14/005,135

(22) PCT Filed: Mar. 16, 2012

(86) PCT No.: PCT/US2012/029537

§ 371 (c)(1), (2), (4) Date: Nov. 25, 2013

(87) PCT Pub. No.: WO2012/125973

PCT Pub. Date: Sep. 20, 2012

(65) Prior Publication Data

US 2014/0073577 A1 Mar. 13, 2014

Related U.S. Application Data

(60) Provisional application No. 61/453,492, filed on Mar. 16, 2011, provisional application No. 61/608,088, filed on Mar. 7, 2012.

(51) Int. Cl.

| | |
|---|---|
| ***C07K 14/435*** | (2006.01) |
| ***C07K 14/00*** | (2006.01) |
| ***A61K 47/48*** | (2006.01) |
| *A61K 38/00* | (2006.01) |

(52) U.S. Cl.

CPC ..... *C07K 14/43518* (2013.01); *A61K 47/48215* (2013.01); *A61K 47/48369* (2013.01); *A61K 47/48438* (2013.01); *C07K 14/00* (2013.01); *A61K 38/00* (2013.01); *C07K 2319/30* (2013.01)

(58) Field of Classification Search

None

See application file for complete search history.

(56) References Cited

U.S. PATENT DOCUMENTS

| | | | |
|---|---|---|---|
| 5,672,688 | A | 9/1997 | Kobayashi et al. |
| 5,756,663 | A | 5/1998 | Lampe et al. |
| 5,877,026 | A | 3/1999 | Lampe |
| 5,968,838 | A | 10/1999 | Lampe et al. |
| 6,670,329 | B2 | 12/2003 | Song-Ping |
| 7,125,676 | B2 | 10/2006 | George, Jr. et al. |
| 7,125,847 | B1 | 10/2006 | Sachs et al. |
| 7,259,145 | B2 | 8/2007 | Sachs et al. |
| 7,375,234 | B2 | 5/2008 | Sharpless et al. |
| 7,393,657 | B2 | 7/2008 | Diss et al. |
| 7,396,816 | B2 | 7/2008 | Yokotagawa et al. |
| 7,485,449 | B2 | 2/2009 | Rouleau et al. |
| 7,528,093 | B2 | 5/2009 | Rouleau et al. |
| 7,531,523 | B2 | 5/2009 | McCormack et al. |
| 7,705,055 | B2 | 4/2010 | Ehring et al. |
| 7,759,078 | B2 | 7/2010 | Djamgoz et al. |
| 7,763,736 | B2 | 7/2010 | Sharpless et al. |
| 7,767,718 | B2 | 8/2010 | Ehring et al. |
| 7,972,813 | B2 | 7/2011 | McCormack et al. |
| 8,399,026 | B2 | 3/2013 | Meir et al. |
| 2004/0146877 | A1 | 7/2004 | Diss et al. |
| 2004/0248207 | A1 | 12/2004 | Okuse et al. |
| 2005/0137190 | A1 | 6/2005 | Gonzalez, III et al. |
| 2005/0187217 | A1 | 8/2005 | Wilson et al. |
| 2006/0025415 | A1 | 2/2006 | Gonzalez, III et al. |
| 2006/0160817 | A1 | 7/2006 | Martinborough et al. |
| 2009/0074665 | A1 | 3/2009 | Diss et al. |
| 2009/0297520 | A1* | 12/2009 | Sullivan et al. ............ 424/134.1 |
| 2010/0273866 | A1 | 10/2010 | Diss et al. |
| 2011/0065647 | A1 | 3/2011 | Meir et al. |
| 2011/0307966 | A1 | 12/2011 | Macdonald et al. |
| 2011/0312533 | A1 | 12/2011 | Shekdar et al. |

FOREIGN PATENT DOCUMENTS

| | | | |
|---|---|---|---|
| EP | 1 280 895 | B1 | 5/2001 |
| WO | WO 95/01436 | A1 | 1/1995 |
| WO | WO 95/11256 | A1 | 4/1995 |
| WO | WO 00/15654 | A1 | 3/2000 |
| WO | WO 01/54472 | A2 | 8/2001 |
| WO | WO 02/083945 | A2 | 10/2002 |
| WO | WO 02/083945 | A3 | 10/2002 |
| WO | WO 03/101972 | A1 | 12/2003 |
| WO | WO 2005/069969 | A2 | 8/2005 |
| WO | WO 2005/118614 | A1 | 12/2005 |

(Continued)

OTHER PUBLICATIONS

Ruta et al., "Localization of the Voltage-Sensor Toxin Receptor KvAP", Biochemistry, 2004, pp. 10071-10079.*

JP 2008-000011; 2008;English translation obtained from JPO and INPIT at https://www4.j-platpat.inpit.go.jp on May 17, 2015; pp. 2-23.*

Ahmad, et al. "A Stop Codon Mutation in SCN9A Causes Lack of Pain Sensation", *Human Molecular Genetics*; 16(17): 2114-2121 (2007).

Black, et al., "Expression of Nav1.7 in DRG Neurons extends from Peripheral Terminals I the Skin to Central Preterminal Branches and Terminals in the Dorsal Horn"; *Molecular Pain*, 8:82, doi:01.1186/1744-8069-8-82 (2012).

(Continued)

*Primary Examiner* — Lianko Garyu

(74) *Attorney, Agent, or Firm* — Angela L. Purcell

(57) ABSTRACT

Disclosed is a composition of matter comprising an isolated polypeptide, which is a peripherally-restricted Nav1.7 inhibitor. In some disclosed embodiments, the isolated polypeptide is an inhibitor of Nav1.7 and/or Nav1.3. Other embodiments are conjugated embodiments of the inventive composition of matter and pharmaceutical compositions containing the inventive composition of matter. Isolated nucleic acids encoding some embodiments of inventive polypeptides and expression vectors, and recombinant host cells containing them are disclosed. A method of treating or preventing pain is also disclosed.

40 Claims, 127 Drawing Sheets

(56) References Cited

FOREIGN PATENT DOCUMENTS

| | | |
|---|---|---|
| WO | WO 2006/014493 A2 | 2/2006 |
| WO | WO 2006/014493 A3 | 2/2006 |
| WO | WO 2007/023298 A2 | 3/2007 |
| WO | WO 2007/054785 A1 | 5/2007 |
| WO | WO 2007/109324 A2 | 9/2007 |
| WO | WO 2007/149542 A2 | 12/2007 |
| WO | WO 2009/033027 A2 | 3/2009 |
| WO | WO 2009/033027 A3 | 3/2009 |
| WO | WO 2009/097530 A2 | 8/2009 |
| WO | WO 2010/104114 A1 | 9/2010 |
| WO | WO 2010/104115 A1 | 9/2010 |
| WO | WO 2010/108154 A2 | 9/2010 |
| WO | WO 2011/033358 A2 | 3/2011 |
| WO | WO 2011/051349 A1 | 5/2011 |
| WO | WO 2011/051350 A1 | 5/2011 |
| WO | WO 2011/051351 A1 | 5/2011 |
| WO | WO 2012/004664 A2 | 1/2012 |
| WO | WO 2012/004664 A3 | 1/2012 |
| WO | WO 2013/173706 A2 | 11/2013 |

OTHER PUBLICATIONS

Bolcskei, et al., "Voltage-Gated Sodium Channel Blockers, 2001-2006: An Overview"; *Medicinal Chemistry Research*; 17: 356-368 (2008).
Bosmans, et al., "Four Novel Tarantula Toxins as Selective Modulators of Voltage-Gated Sodium Channel Subtypes"; *Molecular Pharmacology*; 69: 419-429 (2006).
Bregman, et al., "Identification of a Potent, State-Dependent Inhibitor of Nav1.7 with Oral Efficacy in the Formalin Model of Persistent Pain"; *Journal of Medicinal Chemistry*; 54: 4427-4445 (2011).
Bulaj, et al., "Novel Conotoxins from *Conus striatus* and *Conus kinoshitai* Selectively Block TTX—Resistance sodum Channels"; *Biochemistry*; 44: 7259-7265 (2005).
Casula, et al., "Expression of the Sodium Channel β3 Subunit in Injured Human Sensory Neurons", *Neuro Report*; 15(10): 1629-1632 (2004).
Che, et al., "Soluble Expression and One-Step Purification of a Neurotoxin Huwentoxin-I in *Escherichia coli*", *Protein Expression and Purification*; 65: 154-159 (2009).
Chen, et al., "Antinociceptive Effects of Intrathecally Administered Huwentoxin-I, a Selective N-Type Calcium Channel Blocker, in the Formalin Test in Conscious Rats"; *Toxicon*; 45: 15-20 (2005).
Chen, et al., "Syntheses, Folding and Bioactivity Analysis of K27A—HWTX-IV: A Mutant of the TTX—Sensitive Sodium Channel Inhibitor, Huwentoxin-IV"; *Journal of National Sciences, Human Norm University*; 26(3): 67-72 (2003) (Abstract Only in English).
Clare, Jeffrey J.; "Targeting voltage-Gated Sodium Channels for Pain Therapy"; *Expert Opinion on Investigational Drugs*; 19(1): 45-62 (2010).
Cox., et al, "An SCN9A Channelopathy Causes Congenital Inability to Experience Pain"; *Nature*; 444: 894-898 (2006).
Cummins, et al., "The Roles of Sodium Channels in Nociception: Implications for Mechanisms of Pain"; *Pains*; 131: 243-257 (2007).
Dancik, et al., "De Novo Peptide Sequencing via Tandem Mass Spectrometry", *Journal of Computational Biology*; 6(3/4): 327-342 (1999).
Dib-Hajj, et al., "Voltage-Gated Sodium Channnels in Pain States: Role in Pathophysiology and Target for Treatment"; *Brain Research Reviews*; t0; 65-83 (2009).
Diss, et al., "A Potential Novel Marker for Human Prostate Cancer: Voltage-Gated Sodium Channel Expression in vivo"; *Prostate Cancer and Prostatic Diseases*; 8: 266-273 (2005).
Dray, A., "Neuropathic Pain: Emerging Treatments"; *British Journal of Anaesthesia*;101(1); 48-58 (2008).
Edgerton, et al., "Evidence for Multiple Effects of ProTxII on Activation Gating in Nav1.5"; *Toxicon*; 52: 489-500 (2008).
Edgerton, et al., "Inhibition of the Activation Pathway of the T-Type Calcium Channel Cav3.1 by ProTxII"; *Toxicon*; 56: 624-636 (2010).
Estacion, et al., "A Sodium Channel Mutation Linked to Epilepsy Increases Ramp and Persistent Current of Nav1.3 and Induces Hyperexcitability in Hippoampal neurons", *Experimental Neurology*; 224: 362-368 (2010).
Estacion, et al., "Nav1.7 Gain-of-Function Mutations as a Continuum: A 1632E Displays Physioogical Changes Associated with Erythromelalgia and Paroxysmal Extreme Pain Disorder Mutations and Produces Symptom of Both Disorders"; *Journal of Neuroscience*; 28(43): 11079-1088 (2008).
Favreau, et al., "The Venom of the Snake Genus *Atheris* Contains a New Class of Peptides with Clusters of Histidine and Glycine Residues", *Rapid Communications of Mass Spectrometry*; 21: 406-412 (2007).
Fertleman, et al., "SCN9A Mutations in Paroxysmal Extreme Pain Disorder: Allelic Variants Underlie Distinict Channel Defects and Phenotypes", *Neuron*; 52, 767-774 (2006).
French, et al., "The Tetrodotoxin Receptor of Voltage-Gated Sodium Channels—Perspectives from Interactions with µ-Conotoxins"; *Marine Drugs*; 8: 2153-2161 (2010).
Gao, et al., "Expression of Voltage-Gated Sodium Channel α Subunit in Human Ovarian Cancer", *Oncology Reports*; 23: 1293-1299 (2010).
Gavva, et al., "Repeated Administration of Vanilloid Receptor TRPV1 Antagonists Attenuates Hyperthermis Elicited by TRPV1 Blockade"; *Journal of Pharmacology and Experimental Therapeutics*; 323: 128-137 (2007).
Ghelardini, et al., "Effects of a New Potent Analog of Tocainide on hNav1.7 Sodium Channels and In Vivo Neuropathic Pain Models"; *Neuroscience*; 169: 863-873 (2010).
Goldin, Alan L., "Resurgence of Sodium Channel Research"; *Annual Review Physiology*; 63:871-894 (2001).
Hackel, et al., "Transient Opening of the Perineurial Barrier for Analgesic Drug Delivery"; *Proceedings of the National Academy of Science (PNAS)*; 109(29): E2018-2027 (2012).
Hains, et al., "Changes in Electrophysiological Properties and sodium Channel $Na_v1.3$ Expression in Thalamic Neurons After Spinal Cord Injury", *Brain*; 128: 2359-2371 (2005).
Han, et al., "Structurally Minimized µ-Conotoxin analogues as Sodium Channel Blockers: Implications for Designing Conopeptide-Based Therapeutics"; *ChemMedChem*; 4:406-414 (2009).
Han, et al., "Disulfide-Depleted Selenoconopeptides: a Minimalist Strategy to Oxidative Folding of Cysteine-Rich Peptides", *ACS Medicinal Chemical Letters*; 1(4): 140-144 (2010).
Harris, et al., "Effect of Pegylation on Pharmaceuticals", *Nature*; 2: 214-221 (2003).
Harty, et al., "Nav1.7 Mutant A863P in Erythromelalgia: Effects of Altered Activation and Steady-State Inactivation on Excitability of Nociceptive Dorsal Root GanglionNeurons"; *Journal of Neuroscience*; 26(48): 12566-12575 (2006).
Holland, et al., "Mutation of Sodium Channel SCN3A in a Patient with Cryptogenic Pediatric Partial Epilepsy", *NeuroScience Letters*; 433: 65-70 (2008).
Hoshiba, Junji, "Method for Hand-Feeding Mouse Pups with Nursing Bottles"; *Contemporary Topics*; 43(3): 50-53 (2004).
Hoyt, et al., "Discovery of a Novel Class of Benzazepinone Nav1.7 Blockers: Potential Treatments for Neuropathic Pain"; *Bioorganic & Medicinal Chemistry Letters*; 17: 4630-4634 (2007).
Hoyt, et al., "Benzazepinone Nav1.7 Blockers: Potential Treatments for Neuropathic Pain"; *Bioorganic & Medicinal Chemistry Letters*; 17: 6172-6177 (2007).
Jalali, et al., "OD1, The First Toxin Isolated from the Venom of the Scorpion *Odonthobuthus doriae* Active on Voltage-Gated Na+ Channels"; *FEBS Letters*; 579: 4181-4186 (2005).
Jarvis, et al., "A-803467, a Potent and Selective Nav1.8 Sodium channel blocker, Attenuates Neuropathic and Inflammatory Pain in the Rat"; *PNAS*; 104(20): 8520-8525 (2007).
Ji, et al., "Expression and Purification of Huwentoxin-I in Baculovirus system"; *Protein Expression & Purification*; 41: 454-458 (2005).
Jiang, et al., "Venom Gland Transcriptions of Two Elapid Snakes (Bungarus Multicinctus and Naja Atra) and Evolution of Toxin Genes", *BMC Genomics*; 12(1): downloaded from http://www.biomedcentral.com/1471-2164/12/1; (2011).

(56) References Cited

OTHER PUBLICATIONS

Kanai, et al., "Nav1.7 Sodium Channel-Induced $Ca^{2+}$ Influx Deceases Tau Phosphorylation via Glycogen Synthase Kinase-3β in Adrenal Chromaffin Cells"; *Neurochemistry International*; 54: 497-505 (2009).
Kay, et al., "Convergent Evolution with Combinatorial Peptides", *FEBS Letters*; 480: 55-62 (2000).
Khoo, et al., "Structure of the Analgesic μ-Conotoxin KIIIA and Effects on the Structure and Function of Disulfide Deletion", *Biochemistry*; 48: 1210-1219 (2009).
Klein, et al., "Patterned Electrical Activity Modulates Sodium Channel Expression in Sensory Neurons", *Journal of Neuroscience Research*; 74: 192-198 (2003).
Krafte, et al., "Sodium Channels and Nociception: Recent Concepts and Therapeutic Opportunities", *Current Opinion in Pharmacology*; 8: 50-56 (2008).
Li, et al., "Cloning and Functional Expresion of a Synthetic Gene Encoding Huwentoxin-I, a Neurotoxin From the Chinese Bird Spider (*Selenocosmia huwena*)"; *Toxicon*; 38: 153-162 (2000).
Liang, et al., "Properties and Amino Acid Sequence of Huwentoxin-I, A Neurotoxin Purified from the Venom of the Chinese Bird Spider *Selenocosmia huwena" Toxicon*; 31(8): 969-978 (1993).
Liang, et al., "Oxidative Folding of Reduced and Denatured Huwentoxin-I"; *Journal of Protein Chemistry*; 18(6): 619-625 (1999).
Liang, et al., "The Presynaptic Activity of Huwentoxin-I, a Neurotoxin from the Venom of the Chinese Bird Spider"; *Toxicon*; 38: 1237-1246 (2000).
Lindia, et al., "Relationship Between Sodium Channel $Na_V$1.3 Expression and Neuropathic Pain Behavior in Rats", *Pain*; 117: 145-153 (2003).
Liu, et al., "Assignment of the Disulfide Bonds of Huwentoxin-IV by Partial Reduction and Sequence Analysis"; *College of Life Sciences, Human Normal University*; 24(10): 1815-1819 (2003) (Abstract Only in English).
Maertens, et al., "Potent Modulation of the Voltage-Gated Sodium Channel Nav1.7 by OD1, a Toxin from the Scorpion Odonthobuthus Doriae"; *Molecular Pharmacology*; 70(1): 405-414 (2006).
Mechaly, et al., "Molecular Diversity of Voltage-Gated Sodium Channel Alpha Subunits Expressed in Neuronal and Non-Neuronal Excitable Cells", *Neuroscience*; 130: 389-396 (2005).
Middleton, et al., "Two Tarantula Peptides Inhibit Activation of Multiple Sodium Channels"; *Biochemistry*; 41: 14734-14747 (2002).
Mogil, et al., "The Genetics of Pain and Pain Inhibition"; *PNAS*; 93: 3048-3055 (1996).
Mogil, et al., "Screening for Pain Phenotypes: Analysis of Three Congenic Mouse Strains on a Battery of Nine Nociceptive Assays"; *Pain*; 126: 24-34 (2006).
Nassar, et al., Nerve Injury Induces Robust Allodynia and Ectopic Discharges in $Na_V$1.3 Null Mutant Mice, *Molecular Pain* 2:33; doi: 10.1 186/1744-8069-2-33 (2006).
Nassar, et al., "Neuropathic Pain Develops Normally in Mice Lacking Both Nav1.7 and Nav1.8"; *Molecular Pain*; 1:24: doi: 10.1 186/1744-8069-1-24; (2005).
Nassar, et al., "Nociceptor-Specific Gene Deletion Reveals a Major Role for Nav1.7 (PN1) in Acute and Inflammatory Pain"; *PNAS*; 101(34): 12706-12711 (2004).
Noda, et al., "A Single Point Mutation Confers Tetrodotoxin and Saxitoxin Insensitivity on the Sodium Channel II"; *FEBS Letters*; 259(1): 213-216 (1989).
Norton, et a., "The Cystine Knot Structure of Ion Channel Toxins and Related Polypeptides"; *Toxicon*; 36: 1573-1583 (1998).
Norton, et al., "Potassium Channel Blockade by the Sea Anemone Toxin ShK for the Treatment of Mulitple Sclerosis and Other Autoimmune Diseases", *Current Medicinal Chemistry*; 11: 2041-3052 (2004).
Oliveira, et al., "Binding Specificity of Sea Anemone Toxins to $Na_V$ 1.1-1.6 Sodium Channels", *Journal of Biological Chemistry*; 279(32): 33323-33335 (2004).
Ono, et al., "Characterization of Voltage-Dependent Calcium Channel Blocking Peptides from the Venom of the Tarantula *Grammostola rosea"; Toxicon*; 58: 265-276 (2011).
Peng, et al., "The Effect of Huwentoxin-I on $Ca^2$ Channels in differentiated NG108-15 Cells, a Patch-Clamp Study"; *Toxicon*: 39: 491-498 (2001).
Peng, et al., Addtions and Corrections to "Function and Solution Structure of Huwentoxin-IV, a Potent Neuronal Tetrodotoxin (TTX)-Sensitive Sodium Channel Antagonist from Chinese Bird Spider *Seleno-Cosmia huwena"; Journal of Biological Chemistry* 278(7): 5489 (2003).
Priest, et al., "ProTx-I and ProTx-II: Gating Modifiers of Voltage-Gated Sodium Channels"; *Toxicon*; 49: 1940201 (2007).
Priest, Birgit T., "Future Potential and Status of Selective Sodium Channel Blockers for the Treatment of Pain", *Current Opinion in Drug Discovery & Development*; 12: 682-692 (2009).
Qu, et al., "Proton Nuclear Magnetic Resonance Studies on Huwentoxin-I from the Venom of the Spider *Selenocosmia huwena*: I. Sequence-Specific $^1$H-NMR Assignments"; *Journal of Protein Chemistry*; 14(7): 549-557 (1995).
Qu, et al., "Proton Nuclear Magnetic Resonance Studies on Huwentoxin-I from the Venom of the Spider *Selenocosmia huwena*: 2. Three-Dimensional Structure in Solution"; *Journal of Protein Chemistry*; 16(6): 565-574 (1997).
Rogers, et al., "The Role of Sodium Channels in Neuropathic Pain", *Seminars in Cell & Development Biology*; 17: 571-581 (2006).
Schaller, et al., "Expression and Distribution of Voltage-gated Sodium Channels in the Cerebellum", *The Cerebellum*; 2: 2-9 (2003).
Schmalhofer, et al., "ProTx-II, a Selective Inhibitor of Nav1.7 Sodium Channels, Blocks Action Potential Propagation in Nociceptors"; *Molecular Pharmacology*; 74(5): 1476-1484 (2008).
Siang, et al., "Transcriptomic Analysis of the Venom Gland of the Red-Headed Krait (*Bungarus flaviceps*) using Expressed Sequence Tags", *BMC Molecular Biology*; 11:24; downloaded from http://www.biomedcentral.com/1471-2199/11/24 (2010).
Siqueira, et al., "Abnormal Expression of Voltage-Gated Sodium Channels Nav 1.7, Nav 1.3 and Nav1.8 in Trigeminal Neuralgia", Neuroscience; 164: 573-577 (2009).
Smith, et al., "Differential Phospholipid Binding by Site 3 and Site 4 Toxins: Implications for Structural Variability Between Voltage-Sensitive Sodium Channel Domains"; *Journal of Biological Chemistry*; 280: 11127-11133 (2005).
Smith, et al., Molecular Interactions of the Gating Modifier Toxin ProTx-II with Nav1.5: Implied Existence of a Novel Toxin Binding Site Coupled to Activation; *Journal of Biological Chemistry*; 282: 12687-12697 (2007).
Sokolov, et al., "Inhibition of Sodium Channel Gating by Trapping the Domain II Voltage Sensor with Protoxin II"; *Molecular Pharmacology*; 73(3): 1020-1028 (2008).
Steiner, et al., "Optimization of Oxidative Folding Methods for Cysteine-Rich Peptides: a Study of Conotoxins Containing Three Disulfide Bridges"; *Journal of Peptide Science*; 17: 1-7 (2011).
Stirling, et al., "Nociceptor-Specific Gene Deletion Using Heterozygous Nav1.8—Cre Recombinase Mice"; *Pain*; 113: 27-36 (2005).
Suchyna, et al., "Identification of a Peptide Toxin from Grammostola Spatulata spider Venom that Blocks Cation-Selective Stretch-Activated Channels", *Journal of General Physiology*; 115: 583-598 (2000).
Suchyna, et al., Correction "Identification of a Peptide Toxin from Grammostola Spatulata spider Venom that Blocks Cation-Selective Stretch-Activated Channels", *Journal of General Physiology*; 115: 1 page—590 (2000).
Thimmapaya, et al., "Distribution and Functional Characterization of Human $Na_V$1.3 Splice Variants", *European Journal of Neuroscience*; 22: 1-9 (2005).
Uysal-Onganer, et al., "Epidermal Growth Factor Potentiates in vitro Metastatic Behaviour of Human Prostate Cancer PC-3M Cells: Involvement of Voltage-Gated Sodium Channel"; *Molecular Cancer*; 6:76; doi: 10.1 186/1476-4598-6-76; (2007).
Wang, et al., "Modulatory Effect of Auxiliary $\beta_1$ Subumit on $Na_V$1.3 Voltage-Gated Sodium Channel Expressed in *Xenopus oocyte", Chinese Medical Journal*; 120(8): 721-723 (2007).

(56) References Cited

OTHER PUBLICATIONS

Wang, et al., "The Cross Channel Activities of Spider Neurotoxin Huwentoxin-I on Rat Dorsal Root Ganglion Neurons"; *Biochemical and Biophysical Research Communications*; 357: 579-583 (2007).
Weiss, et al., "Loss-of-Function Mutations in Sodium Channel $Na_V$ 1.7 Cause Anosmia", *Nature*; doi: 10.1038/nature09975; (2011).
Wood, et al., "Voltage-Gated Sodium Channels and Pain Pathways", *Journal of Neurobiology*; 61: 55-71 (2004).
Xiao, et al., "Tarantula Huwentoxin-IV Inhibits Neuronal Sodium Channels by Binding to Receptor Site 4 and Trapping the Domain II Voltage Sensor in the Closed Configuration", *Journal of Biological Chemistry*; 283(40): 27300-27313 (2008).
Xiao, et al., "The Tarantula Toxins ProTx-II and HWTX-IV Differentially Interact with Human Hav 1.7 Voltage-Sensors to Inhibit Channel Activation and Inactivation", *Molecular Pharmacology Fast Forward*; doi: 10.1124/mol.110.066332; (2010).
Xiao, et al., "Synthesis andCharacterization of Huwentoxin-IV, a Neurotoxin Inhibiting Central Neuronal Sodium Channels"; *Toxicon*; 51: 230-239 (2008).
Yaksh, et al., "An Automated Flinch Detecting System for Use in the Formalin Nociceptive Bioassay"; *Journal of Applied Physiology*; 90: 2386-2402 (2001).
Yang, et al., "Mutations in SCN9A, Encoding a Sodium Channel Alpha Subunit, in Patients with Primary Erythermalgia"; *Journal of Medical Genetics*; 41: 171-174 (2004).
Yeomans, et al., "Decrease in Inflammatory Hyperalgesia by Herpes Vector-Mediated Knockdown of Nav1.7 Sodum Channels in Primary Afferents"; *Human Gene Therapy*; 16: 271-277 (2005).
Yuan, et al., "Effects and Mechanism of Chinese Tarantula Toxins on the Kv2.1 Potassium Channels"; *Biopchemical andBiophysical Research Communications*; 352: 799-804 (2007).
Zeng, et al., "Isolation and Characterization of Jingzhaotoxin-V, a Novel Neurotoxin from the venom of the Spider *Chilobrachys jingzhao"; Toxicon*; 49: 388-399 (2007).
Zhang, et al., "Structure/Function Characterization of μ-Conotoxin KIIIA, an analgesic, nearly Irreversible Blocker of Mammalian Neuronal Sodium Channels", *Journal of Biological Chemistry*; 282(42): 30699-30706 (2007).
Zhang, et al., "μ-Conotoxin KIIIA Derivatives with Divergent Affinities Versus Efficacies in Blocking Voltage-Gates Sodium Channels", *Biochemistry*; 49: 4804-4812 (2010).
Zhang, et al., "Assignment of the Three Disulfide Bridges of Huwentoxin-I, a Neurotoxin from the Spider *Selenocosmia huwena"; Journal of Protein Chemistry*; 112(6): 735-740 (1993).
Zhang, et al., "Synergistic and Antagonistic Interactions Between Tetrodotoxin and μ-Conotoxin in Blocking Voltage-Gated Sodium Channels"; *Channels* (Austin); 3(1): 32-38 (2009).
Zhang, et al., "Cooccupancy of the Outer Vestibule of Voltage-Gated Sodium channels by μ-Conotoxin KIIIA and Saxitoxin or Tetrodotoxin"; *Journal Neurophysiology*; 104: 88-97 (2010).
Zhou, et al., Blockade of Neuromuscular Transmission by Huwentoxin-I, Purified From the Venom of the Chinese Bird Spider *Selenocosmia huwena; Toxicon*; 35(1): 39-45 (1997).
Zuliani, et al., "Recent Advances in the Medicinal Chemistry of Sodium Channel Blockers and their Therapeutic Potential"; *Current Topics in Medicinal Chemistry*; 9: 396-415 (2009).
Bosmans, Frank (2010), "Targeting sodium channel voltage sensors with spider toxins", Trends Pharmacol. Sci., 31(4):175-182. Doi:10.1016/j.tips.2009.12.007.

* cited by examiner

SNL

```
KIIIA            1 CCNCSSKWCR-DHSRCC                      16
GpTx-1{1-34}     1 DCLGFMRKCIPDNDKCCRPN-LVCSRTHKWCKYVF    34
Huwentoxin-IV    1 ECLEIFKACNPSNDQCCKSSKLVCSRKTRWCKYQI    35
Huwentoxin-I     1 ACKGVFDACTPGKNECCPNR--VCSDKHKWCKWKL    33
ProTx II         1 YCQKWMWTCD-SERKCCEGM--VCR---LWCKKKLW  30
                     *       *       **
```

Total Rearing

Pra13
[Phe6,Pra13]GpTx-1(1-34) (SEQ ID NO:1049)
2kDa PEG bis-azide
Atz13
Homodimeric Conjugate 1

Pra13

[Ala5,Phe6,Pra13,Leu26,Arg38]GpTx-1(1-34) (SEQ ID NO. 640)

azido-PEG11-bromoacetamide

Atz13

[Ala5,Phe6,Atz(PEG11-bromoacetamide)13,Leu26,Arg28]GpTx-1(1-34) (SEQ ID NO:1062)

anti-DNP mAb (E273C) hIgG1
(comprising immunoglobulin monomers
SEQ ID NO:3087; SEQ ID NO:3088;
SEQ ID NO:3087; SEQ ID NO:3088)

Immunoglobulin-peptide Conjugate 1

Total Fine Movement

Total Basic Movement

Total Time Rearing

Total Rearing

POTENT AND SELECTIVE INHIBITORS OF $NA_V1.3$ AND $NA_V1.7$

This application is a national stage application under 35 U.S.C. 371 of International Application No. PCT/US2012/029537, filed Mar. 16, 2012, which claims the benefit of U.S. Provisional Application No. 61/608,088, filed on Mar. 7, 2012, and of U.S. Provisional Application No. 61/453,492, filed on Mar. 16, 2011, the contents of which are hereby incorporated by reference in their entirety.

The present application is being filed along with a Sequence Listing in electronic format. The Sequence Listing is provided as a file entitled A-1592-WO-PCT-SeqList031212.txt, created Mar. 12, 2012, which is 1,668 KB in size. The information in the electronic format of the Sequence Listing is incorporated herein by reference in its entirety.

Throughout this application various publications are referenced within parentheses or brackets. The disclosures of these publications in their entireties are hereby incorporated by reference in this application in order to more fully describe the state of the art to which this invention pertains.

BACKGROUND OF THE INVENTION

1. Field of the Invention

The present invention relates to the biochemical arts, in particular to therapeutic peptides and conjugates.

2. Discussion of the Related Art

Voltage-gated sodium channels (VGSC) are glycoprotein complexes responsible for initiation and propagation of action potentials in excitable cells such as central and peripheral neurons, cardiac and skeletal muscle myocytes, and neuroendocrine cells. Mammalian sodium channels are heterotrimers, composed of a central, pore-forming alpha (α) subunit and auxiliary beta (β) subunits. Mutations in alpha subunit genes have been linked to paroxysmal disorders such as epilepsy, long QT syndrome, and hyperkalemic periodic paralysis in humans, and motor endplate disease and cerebellar ataxia in mice. (Isom, Sodium channel beta subunits: anything but auxiliary, Neuroscientist 7(1):42-54 (2001)). The β-subunit modulates the localization, expression and functional properties of α-subunits in VGSCs.

Voltage gated sodium channels comprise a family consisting of 9 different subtypes ($Na_V1.1$-$Na_V1.9$). As shown in Table 1, these subtypes show tissue specific localization and functional differences (See, Goldin, A. L., Resurgence of sodium channel research, Annu Rev Physiol 63: 871-94 (2001); Wilson et al., Compositions useful as inhibitors of voltage-gated ion channels, US 2005/0187217 A1). Three members of the gene family ($Na_V1.8$, 1.9, 1.5) are resistant to block by the well-known sodium channel blocker tetrodotoxin (TTX), demonstrating subtype specificity within this gene family. Mutational analysis has identified glutamate 387 as a critical residue for TTX binding (See, Noda, M., H. Suzuki, et al., A single point mutation confers tetrodotoxin and saxitoxin insensitivity on the sodium channel II" FEBS Lett 259(1): 213-6 (1989)).

TABLE 1

VGSC family with rat TTX $IC_{50}$ values.

| VGSC isoform | Tissue | TTX $IC_{50}$ (nM) | Indication |
|---|---|---|---|
| $Na_v1.1$ | CNS, PNS soma of neurons | 10 | Pain, Epilepsy, Neurodegeneration |
| $Na_v1.2$ | CNS high in axons | 10 | Neurodegeneration, Epilepsy |
| $Na_v1.3$ | CNS, embryonic, injured nerves | 2-15 | Pain, Epilepsy |
| $Na_v1.4$ | Skeletal muscle | 5 | Myotonia |
| $Na_v1.5$ | heart | 2000 | Arrhythmia, long QT |
| $Na_v1.6$ | CNS widespread, most abundant | 1 | Pain, movement disorders |
| $Na_v1.7$ | PNS, DRG, terminals neuroendocrine | 4 | Pain, Neuroendocrine disorders, prostate cancer |
| $Na_v1.8$ | PNS, small neurons in DRG & TG | >50,000 | Pain |
| $Na_v1.9$ | PNS, small neurons in DRG & TG | 1000 | Pain |

Abbreviations: CNS = central nervous system, PNS = peripheral nervous system, DRG = dorsal root ganglion, TG = Trigeminal ganglion. (See, Wilson et al., Compositions useful as inhibitors of Voltage-gated ion channels, US 2005/0187217 A1; Goldin, Resurgence of Sodium Channel Research, Annu Rev Physiol 63: 871-94 (2001)).

In general, voltage-gated sodium channels (Nays) are responsible for initiating the rapid upstroke of action potentials in excitable tissue in the nervous system, which transmit the electrical signals that compose and encode normal and aberrant pain sensations. Antagonists of $Na_V$ channels can attenuate these pain signals and are useful for treating a variety of pain conditions, including but not limited to acute, chronic, inflammatory, and neuropathic pain. Known Nay antagonists, such as TTX, lidocaine, bupivacaine, phenyloin, lamotrigine, and carbamazepine, have been shown to be useful for attenuating pain in humans and animal models. (See, Mao, J. and L. L. Chen, Systemic lidocaine for neuropathic pain relief, Pain 87(1): 7-17 (2000); Jensen, T. S., Anticonvulsants in neuropathic pain: rationale and clinical evidence, Eur J Pain 6 (Suppl A): 61-68 (2002); Rozen, T. D., Antiepileptic drugs in the management of cluster headache and trigeminal neuralgia, Headache 41 Suppl 1: S25-32 (2001); Backonja, M. M., Use of anticonvulsants for treatment of neuropathic pain, Neurology 59(5 Suppl 2): S14-7 (2002)).

The α-subunits of TTX-sensitive, voltage-gated $Na_V1.7$ channels are encoded by the SCN9A gene. The $Na_V1.7$ channels are preferentially expressed in peripheral sensory neurons of the dorsal root ganglia, some of which are involved in the perception of pain. In humans, mutations in the SCN9A gene have shown a critical role for this gene in pain pathways. For instance, a role for the $Na_V1.7$ channel in pain perception was established by recent clinical gene-linkage analyses that revealed gain-of-function mutations in the SCN9A gene as the etiological basis of inherited pain syndromes such as primary erythermalgia (PE), inherited erythromelalgia (IEM), and paroxysmal extreme pain disorder (PEPD). (See, e.g., Yang et al., Mutations in SCN9A, encoding a sodium channel alpha subunit, in patients with primary erythermalgia, J. Med. Genet. 41:171-174 (2004); Harty et al., $Na_V1.7$ mutant A863P in erythromelalgia: effects of altered activation and steady-state inactivation on excitability of nociceptive dorsal root ganglion neurons, J. Neurosci. 26(48):12566-75 (2006); Estacion et al., $Na_V1.7$ gain-of-function mutations as a continuum: A1632E displays physiological changes associated with erythromelalgia and paroxysmal extreme pain disorder mutations and produces symptoms of both disorders, J. Neurosci. 28(43):11079-88 (2008)). In addition, overexpression of $Na_V1.7$ has been detected in strongly metastatic prostate cancer cell lines. (Diss et al., A potential novel marker for human prostate cancer: voltage-gated sodium channel expression in vivo, Prostate Cancer and Prostatic Diseases 8:266-73 (2005); Uysal-Onganer et al., Epidermal growth factor potentiates in vitro metastatic behavior human prostate cancer PC-3M cells: involvement of voltage-gated sodium channel, Molec. Cancer 6:76 (2007)).

Loss-of-function mutations of the SCN9A gene result in a complete inability of an otherwise healthy individual to sense any form of pain. (e.g., Ahmad et al., A stop codon mutation in SCN9A causes lack of pain sensation, Hum. Mol. Genet. 16(17):2114-21 (2007)).

A cell-specific deletion of the SCN9A gene in conditional knockout mice reduces their ability to perceive mechanical, thermal or inflammatory pain. (Nassar et al., Nociceptor-specific gene deletion reveals a major role for $Na_V1.7$ (PN1) in acute and inflammatory pain, Proc. Natl. Acad. Sci, USA. 101(34): 12706-12711 (2004)).

Based on such evidence, decreasing $Na_V1.7$ channel activity or expression levels in peripheral sensory neurons of the dorsal root ganglia (DRG) has been proposed as an effective pain treatment, e.g. for chronic pain, neuropathic pain, and neuralgia. (E.g., Thakker et al., Suppression of SCN9A gene expression and/or function for the treatment of pain, WO 2009/033027 A2; Yeomans et al., Decrease in inflammatory hyperalgesia by herpes vector-mediated knockdown of $Na_V1.7$ sodium channels in primary afferents, Hum. Gene Ther. 16(2):271-7 (2005); Fraser et al., Potent and selective $Na_V1.7$ sodium channel blockers, WO 2007/109324 A2; Hoyt et al., Discovery of a novel class of benzazepinone Na(v)1.7 blockers: potential treatments for neuropathic pain, Bioorg. Med. Chem. Lett. 17(16):4630-34 (2007); Hoyt et al., Benzazepinone $Na_V1.7$ blockers: Potential treatments for neuropathic pain, Bioorg. Med. Chem. Lett. 17(22):6172-77 (2007)).

The α-subunits of TTX-sensitive, voltage-gated $Na_V1.3$ channels are encoded by the SCN3A gene. Four splice variants of human Nav1.3 were reported to have different biophysical properties. (Thimmapaya et al., Distribution and functional characterization of human $Na_V1.3$ splice variants, Eur. J. Neurosci. 22:1-9 (2005)). Expression of $Na_V1.3$ has been shown to be upregulated within DRG neurons following nerve injury and in thalamic neurons following spinal cord injury. (Hains et al., Changes in electrophysiological properties and sodium channel $Na_V1.3$ expression in thalamic neurons after spinal cord injury, Brain 128:2359-71 (2005)). A gain-in-function mutation in $Na_V1.3$ (K354Q) was reportedly linked to epilepsy. (Estacion et al., A sodium channel mutation linked to epilepsy increases ramp and persistent current of $Na_V1.3$ and induces hyperexcitability in hippocampal neurons, Experimental Neurology 224(2):362-368 (2010)).

Toxin peptides produced by a variety of organisms have evolved to target ion channels. Snakes, scorpions, spiders, bees, snails and sea anemones are a few examples of organisms that produce venom that can serve as a rich source of small bioactive toxin peptides or "toxins" that potently and selectively target ion channels and receptors. In most cases, these toxin peptides have evolved as potent antagonists or inhibitors of ion channels, by binding to the channel pore and physically blocking the ion conduction pathway. In some other cases, as with some of the tarantula toxin peptides, the peptide is found to antagonize channel function by binding to a region outside the pore (e.g., the voltage sensor domain).

Native toxin peptides are usually between about 20 and about 80 amino acids in length, contain 2-5 disulfide linkages and form a very compact structure. Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency, stability, and selectivity. (See, e.g., Dauplais et al., On the convergent evolution of animal toxins: conservation of a diad of functional residues in potassium channel-blocking toxins with unrelated structures, J. Biol. Chem. 272(7):4302-09 (1997); Alessandri-Haber et al., Mapping the functional anatomy of BgK on Kv1.1, Kv1.2, and Kv1.3, J. Biol. Chem. 274(50):35653-61 (1999)). The majority of scorpion and *Conus* toxin peptides, for example, contain 10-40 amino acids and up to five disulfide bonds, forming extremely compact and constrained structures (microproteins) often resistant to proteolysis. The conotoxin and scorpion toxin peptides can be divided into a number of superfamilies based on their disulfide connections and peptide folds. The solution structure of many of these has been determined by Nuclear Magnetic Resonance (NMR) spectroscopy, illustrating their compact structure and verifying conservation of their family folding patterns. (E.g., Tudor et al., Ionisation behaviour and solution properties of the potassium-channel blocker ShK toxin, Eur. J. Biochem. 251(1-2):133-41 (1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from *Orthochirus scrobiculosus* scorpion venom, Biochem. 36(6):1223-32 (1997); del Rio-Portillo et al.; NMR solution structure of Cn12, a novel peptide from the Mexican scorpion *Centruroides noxius* with a typical beta-toxin sequence but with alpha-like physiological activity, Eur. J. Biochem. 271(12): 2504-16 (2004); Prochnicka-Chalufour et al., Solution structure of discrepin, a new K+-channel blocking peptide from the alpha-KTx15 subfamily, Biochem. 45(6):1795-1804 (2006)). Conserved disulfide structures can also reflect the individual pharmacological activity of the toxin family. (Nicke et al. (2004), Eur. J. Biochem. 271: 2305-19, Table 1; Adams (1999), Drug Develop. Res. 46: 219-34). For example, α-conotoxins have well-defined four cysteine/two disulfide loop structures (Loughnan, 2004) and inhibit nicotinic acetylcholine receptors. In contrast, ω-conotoxins have six cysteine/three disulfide loop consensus structures (Nielsen, 2000) and block calcium channels. Structural subsets of toxins have evolved to inhibit either voltage-gated or calcium-activated potassium channels.

Spider venoms contain many peptide toxins that target voltage-gated ion channels, including Kv, Cav, and Nav channels. A number of these peptides are gating modifiers that conform to the inhibitory cystine knot (ICK) structural motif. (See, Norton et al., The cystine knot structure of ion channel toxins and related polypeptides, Toxicon 36(11):1573-1583 (1998); Pallaghy et al., A common structural motif incorporating a cystine knot and a triple-stranded β-sheet in toxic and inhibitory polypeptides, Prot. Sci. 3(10):1833-6, (1994)). In contrast to some scorpion and sea anemone toxins, many spider toxins do not affect the rate of inactivation but inhibit channel activity by restricting the movement of the voltage sensor into the open channel conformation, shifting their voltage dependence of activation to a more positive potential. Many of these spider toxins are promiscuous within and across voltage-gated ion channel families.

A variety of toxin peptides that target VGSCs, in particular, have been reported. (See, Billen et al., Animal peptides targeting voltage-activated sodium channels, Cur. Pharm. Des. 14:2492-2502, (2008)). Three classes of peptide toxins have been described: 1) site 1 toxins, the μ-conotoxins, bind to the pore of the channel and physically occlude the conduction pathway; 2) site 3 toxins, including the α-scorpion toxins, some sea anemone toxins and δ-conotoxins, bind to the S3-S4 linker of domain IV and slow channel inactivation; and 3) site 4 toxins, including the β-scorpion toxins, bind to the S3-S4 linker in domain II and facilitate channel activation. Both site 3 and site 4 families of peptides alter the open probability of $Na_V$ channels and affect gating transitions and are therefore called “gating modifiers.”

μ-Conotoxin KIIIA (SEQ ID NO:530), a site 1 toxin originally isolated from *Conus kinoshitai*, is a C-terminally amidated peptide 16 amino acids in length that contains 6 cysteine residues engaged in 3 intramolecular disulfide bonds. It was initially characterized as an inhibitor of tetrodotoxin (TTX)-resistant sodium channels in amphibian dorsal root ganglion (DRG) neurons. (See, Bulaj et al., Novel conotoxins from *Conus striatus* and *Conus kinoshitai* selectively block TTX-resistant sodium channels, Biochem. 44(19):7259-7265, (2005)). Later it was found to more effectively inhibit TTX-sensitive than TTX-resistant sodium current in mouse DRG neurons. (See, Zhang et al., Structure/function characterization of μ-conotoxin KIIIA, an analgesic, nearly irreversible blocker of mammalian neuronal sodium channels, J. Biol. Chem. 282(42):30699-30706, (2007)). KIIIA has been found to block cloned mammalian (rodent) channels expressed in *Xenopus laevis* oocytes with the following rank order potency: $Na_V1.2>Na_V1.4>Na_V1.6>Na_V1.7>Na_V1.3>Na_V1.5$. Intraperitoneal injection of KIIIA has demonstrated analgesic activity in a formalin-induced pain assay in mice with an $ED_{50}$ of 1.6 nmol/mouse (0.1 mg/kg) without observed motor impairment; some motor impairment but not paralytic acitity was observed at a higher dose (10 nmol). (See, Zhang et al., 2007). Substitution of alanine for Lys7 and Arg10 modified maximal block, while substitution of His12 and Arg14 altered Nav isoform specificity. (See, McArthur et al., Interactions of key charged residues contributing to selective block of neuronal sodium channels by μ-conotoxin KIIIA, Mol. Pharm. 80(4): 573-584, (2011)). “Alanine scan” analogs of KIIIA have identified Lys7, Trp8, Arg10, Asp11, His12, and Arg14 as being important for activity against $rNa_V1.4$. (See Zhang et al., 2007). The NMR solution structure of KIIIA places these residues within or adjacent to an α-helix near the C-terminus of the molecule. (See, Khoo et al., Structure of the analgesic μ-conotoxin KIIIA and effects on the structure and function of disulfide deletion, Biochem. 48(6):1210-1219, (2009)). The disulfide bond between Cys1 and Cys9 may be removed by substitution of alanine (KIIIA [C1A,C9A]) without greatly reducing the activity of the compound. (See, Khoo et al., 2009; Han et al., Structurally minimized μ-conotoxin analogs as sodium channel blockers: implications for designing conopeptide-based therapeutics, ChemMedChem 4(3):406-414, (2009)). Replacing a second disulfide bond between Cys2 and Cys16 with a diselenide bond between selenocysteine residues has given rise to the disulfide-depleted selenoconopeptide analogs of KIIIA. These compounds have retained the activity of KIIIA but are more synthetically accessible. (See, Han et al., Disulfide-depleted selenoconopeptides: simplified oxidative folding of cysteine-rich peptides, ACS Med. Chem. Lett. 1(4):140-144, (2010)). The native structure has been further minimized to a lactam-stabilized helical peptide scaffold with Nav inhibitory activity. (See, Khoo et al., Lactam-stabilized helical analogues of the analgesic μ-conotoxin KIIIA, J. Med. Chem. 54:7558-7566 (2011)). KIIIA binds to the neurotoxin receptor site 1 in the outer vestibule of the conducting pore of the VGSCs and blocks the channel in an all-or-none manner. Recent studies have shown that some analogs of KIIIA only partially inhibit the sodium current and may be able to bind simultaneously with TTX and saxitoxin (STX). (See, Zhang et al., Cooccupancy of the outer vestibule of voltage-gated sodium channels by μ-conotoxin KIIIA and saxitoxin or tetrodotoxin, J. Neurophys. 104(1):88-97, (2010); French et al., The tetrodotoxin receptor of voltage-gated sodium channels—perspectives from interactions with μ-conotoxins, Marine Drugs 8:2153-2161, (2010); Zhang et al., μ-Conotoxin KIIIA derivatives with divergent affinities versus efficacies in blocking voltage-gated sodium channels. Biochem. 49(23):4804-4812, (2010); Zhang et al., Synergistic and antagonistic interactions between tetrodotoxin and μ-conotoxin in blocking voltage-gated sodium channels, Channels 3(1):32-38, (2009)).

OD1 (SEQ ID NO:589) is an α-like toxin isolated from the venom of the Iranian yellow scorpion *Odonthobuthus doriae*. (See, Jalali et al., OD1, the first toxin isolated from the venom of the scorpion *Odonthobuthus doriae* active on voltage-gated Na+ channels, FEBS Lett. 579(19):4181-4186, (2005)). This peptide is 65 amino acids in length with an amidated C-terminus containing 6 cysteine residues that form 3 disulfide bonds. OD1 has been characterized as an $Na_V1.7$ modulator that impairs fast inactivation ($EC_{50}$=4.5 nM), increases the peak current at all voltages, and induces a persistent current, with selectivity against $Na_V1.8$ and $Na_V1.3$. (See Maertens et al., Potent modulation of the voltage-gated sodium channel $Na_V1.7$ by OD1, a toxin from the scorpion *Odonthobuthus doriae*, Mol. Pharm. 70(1):405-414, (2006)).

Huwentoxin-IV (HWTX-IV; SEQ ID NO:528) is a 35 residue C-terminal peptide amide with 3 disulfide bridges between 6 cysteine residues isolated from the venom of the Chinese bird spider, *Selenocosmia huwena*. (See, Peng et al., Function and solution structure of huwentoxin-IV, a potent neuronal tetrodotoxin (TTX)-sensitive sodium channel antagonist from chinese bird spider *Selenocosmia huwena*, J. Biol. Chem. 277(49):47564-47571, (2002)). The disulfide bonding pattern (C1-C4, C2-C5, C3-C6) and NMR solution structure place HWTX-IV in the ICK structural family since the C3-C6 disulfide bond passes through the 16-residue ring formed by the other two disulfide bridges (C1-C4 and C2-C5). HWTX-IV inhibits TTX-sensitive sodium currents in adult rat DRG neurons with an $IC_{50}$ value of 30 nM but has no effect on TTX-resistant VGSCs at up to a 100 nM concentration. (See, Peng et al., 2002). HWTX-IV was also 12-fold less potent against central neuronal sodium channels in rat hippocampus neurons, suggesting that it may be selective toward $Na_V1.7$. (See, Xiao et al., Synthesis and characterization of huwentoxin-IV, a neurotoxin inhibiting central neuronal sodium channels, Toxicon 51(2):230-239, (2008)). Testing HWTX-IV against VGSC sub-types determined the relative sensitivity to be hNav1.7 ($IC_{50}$=26 nM)>rNav1.2>>rNav1.3>rNav1.4≥hNav1.5. (See Xiao et al., Tarantula huwentoxin-IV inhibits neuronal sodium channels by binding to receptor site 4 and trapping the domain II voltage sensor in the closed configuration, J. Biol. Chem. 283(40):27300-27313, (2008)). Site directed protein mutagenesis mapped the binding of HWTX-IV to neurotoxin site 4, the extracellular S3-S4 linker between domain II, and its behavior in response to changes in voltage and channel activation is consistent with binding to the voltage sensor of Nav1.7 and trapping it in the resting configuration. (See, Xiao et al., 2008). Huwentoxin-I (HWTX-I; SEQ ID NO:529), a related family member is less potent against VGSCs but is active against N-Type $Ca_V$ channels. (See, Wang et al., The cross channel activities of spider neurotoxin huwentoxin I on rat dorsal root ganglion neurons, Biochem. Biophys. Res. Comm. 357(3):579-583, (2007); Chen et al., Antinociceptive effects of intrathecally administered huwentoxin-I, a selective N-type calcium channel blocker, in the formalin test in conscious rats, Toxicon 45(1):15-20, (2005); Liang et al., Properties and amino acid sequence of huwentoxin-I, a neurotoxin purified from the venom of the Chinese bird spider *Selenocosmia huwena*, Toxicon 31(8):969-78, (1993)).

ProTx-II (SEQ ID NO:531), isolated from the venom of the tarantula *Thixopelma pruriens*, is a 30 amino acid polypeptide with a C-terminal free acid and 6 cysteine residues that form 3 disulfide bonds. It differs from other members of the ICK family because it contains only three residues between the fifth and sixth cysteine residues instead of the normal 4-11. ProTx-II is a potent inhibitor of several $Na_V$ channel sub-types including $Na_V1.2$, $Na_V1.7$ ($IC_{50}$<1 nM), $Na_V1.5$, and $Na_V1.8$, as well as Cav3.1 channels but not $K_V$ channels. (See, Middleton et al., Two tarantula peptides inhibit activation of multiple sodium channels, Biochem. 41(50):14734-14747, (2002); Priest et al., ProTx-I and ProTx-II: gating modifiers of voltage-gated sodium channels, Toxicon 49(2): 194-201, (2007); Edgerton et al, Inhibition of the activation pathway of the T-type calcium channel CaV3.1 by ProTxII, Toxicon 56(4):624-636, (2010)). The "alanine scan" analogs of ProTx-II were tested against Nav1.5, identifying Met6, Trp7, Arg13, Met19, Val20, Arg22, Leu23, Trp24, Lys27, Leu29, and Trp30 as being important for activity. (See, Smith et al., Molecular interactions of the gating modifier toxin ProTx-II with Nav1.5: implied existence of a novel toxin binding site coupled to activation, J. Biol. Chem. 282(17): 12687-12697, (2007)). Biophysical characterization showed that ProTx-II differs from HwTx-IV in its ability to interact with lipid membranes. (See, Smith et al., Differential phospholipid binding by site 3 and site 4 toxins: implications for structural variability between voltage-sensitive sodium channel comains, J. Biol. Chem. 280(12):11127-11133, (2005). Doses of 0.01 and 0.1 mg/kg i.v. of ProTx-II were well tolerated in rats, but 1 mg/kg doses were lethal. ProTx-II was not efficacious in a mechanical hyperalgesia study. (See, Schmalhofer et al., ProTx-II, a selective inhibitor of NaV1.7 sodium channels, blocks action potential propagation in nociceptors, Mol. Pharm. 74(5):1476-1484, (2008)). Intrathecal administration was lethal at 0.1 mg/kg and not effective in the hyperalgesia study at lower doses. ProTx-II application to desheathed cutaneous nerves completely blocked the C-fiber compound action potential but had little effect on action potential propagation of the intact nerve. (See, Schmalhofer et al., 2008). ProTx-II is believed to bind to the S3-S4 linker of domain II of $Na_V1.7$ to inhibit channel activation but may also interact with the domain IV voltage sensor and affect sodium channel activation at higher concentrations. (See, Xiao et al., The tarantula toxins ProTx-II and huwentoxin-IV differentially interact with human $Na_V1.7$ voltage sensors to inhibit channel activation and inactivation, Mol. Pharm. 78(6):1124-1134, (2010); Sokolov et al, Inhibition of sodium channel gating by trapping the domain II voltage sensor with protoxin II, Mol. Pharm. 73(3):1020-1028, (2008); Edgerton et al., Evidence for multiple effects of ProTxII on activation gating in NaV1.5, Toxicon 52(3):489-500, (2008)).

Production of toxin peptides is a complex process in venomous organisms, and is an even more complex process synthetically. Due to their conserved disulfide structures and need for efficient oxidative refolding, toxin peptides present challenges to synthesis. (See, Steiner and Bulaj, Optimization of oxidative folding methods for cysteine-rich peptides: a study of conotoxins containing three disulfide bridges, J. Pept. Sci. 17(1): 1-7, (2011); Góngora-Benítez et al., Optimized Fmoc solid-phase synthesis of the cysteine-rich peptide Linaclotide, Biopolymers Pept. Sci. 96(1):69-80, (2011)). Although toxin peptides have been used for years as highly selective pharmacological inhibitors of ion channels, the high cost of synthesis and refolding of the toxin peptides and their short half-life in vivo have impeded the pursuit of these peptides as a therapeutic modality. Far more effort has been expended to identify small molecule inhibitors as therapeutic antagonists of ion channels, than has been given the toxin peptides themselves. One exception is the approval of the small ω-conotoxin MVIIA peptide (Prialt®, ziconotide), an inhibitor of neuron-specific N-type voltage-sensitive calcium channels, for treatment of intractable pain. The synthetic and refolding production process for ziconotide, however, is costly and only results in a small peptide product with a very short half-life in vivo (about 4 hours).

A small clinical trial in humans showed that local, non-systemic injection of the non-peptide tetrodotoxin produced pain relief in patients suffering from pain due to cancer and/or to chemotherapy (Hagen et al., J Pain Symp Manag 34:171-182 (2007)). Tetrodotoxin is a non-CNS-penetrant inhibitor of sodium channels including $Na_V1.3$ and $Na_V1.7$; although it cannot be used systemically due to lack of selectivity among sodium channel subtypes, its efficacy provides further validation for treating chronic pain syndromes with inhibitors of $Na_V1.7$ and/or $Na_V1.3$ in peripheral neurons.

Polypeptides typically exhibit the advantage of greater target selectivity than is characteristic of small molecules. Non-CNS penetrant toxin peptides and peptide analogs selective for Nav1.7 and/or Nav1.3 are desired, and are provided by the present invention.

SUMMARY OF THE INVENTION

The present invention is directed to a composition of matter comprising an isolated polypeptide, which is a peripherally-restricted $Na_V1.7$ inhibitor. In one embodiment, the isolated polypeptide is a dual inhibitor of $Na_V1.7$ and $Na_V1.3$ having the amino acid sequence DCLGFMRKCIPDNDKCCRPNLVCSRTHKWCKYVF-$NH_2$ (SEQ ID NO:1), which is a peptide we have designated "GpTx-1", and which was isolated from the venom of the tarantula *Grammostola porteri*, as described herein. Other embodiments of the present invention comprise a peptide analog of GpTx-1. In other embodiments, the present invention is directed to a composition of matter comprising an isolated polypeptide comprising the amino acid sequence of the formula:

SEQ ID NO: 475

$$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}$$

$$X_{aa}^{12}X_{aa}^{13}X_{aa}^{14}Asp^{15}X_{aa}^{16}X_{aa}^{17}X_{aa}^{18}X_{aa}^{19}X_{aa}^{20}X_{aa}^{21}$$

$$X_{aa}^{22}X_{aa}^{23}X_{aa}^{24}X_{aa}^{25}X_{aa}^{26}X_{aa}^{27}X_{aa}^{28}X_{aa}^{29}X_{aa}^{30}X_{aa}^{31}$$

$$Lys^{32}X_{aa}^{33}X_{aa}^{34}X_{aa}^{35}X_{aa}^{36}X_{aa}^{37}X_{aa}^{38}//$$

or a pharmaceutically acceptable salt thereof, wherein:

$X_{aa}^1X_{aa}^2$ is absent; or $X_{aa}^1$ is any amino acid residue and $X_{aa}^2$ is any amino acid residue; or $X_{aa}^1$ is absent and $X_{aa}^2$ is any amino acid residue;

$X_{aa}^3$ is Cys, if $X_{aa}^{18}$ is Cys; or $X_{aa}$ is SeCys, if $X_{aa}^{18}$ is SeCys; or $X_{aa}$ is an alkyl amino acid residue, if $X_{aa}^{18}$ is an alkyl amino acid residue;

$X_{aa}^4$ is an acidic, hydrophobic, basic, or neutral hydrophilic amino acid residue;

$X_{aa}^5$ is a Gly, Ala, hydrophobic, or basic amino acid residue;

$X_{aa}^6$ is a Gly, Ala, 2-Abu, Nle, Nva, or hydrophobic amino acid residue;

$X_{aa}^1$ is a Gly, Ala, aromatic, or hydrophobic amino acid residue;

$X_{aa}^{8}$ is a basic, acidic, or neutral hydrophilic amino acid residue, or an Ala residue;

$X_{aa}^{9}$ is a basic or neutral hydrophilic amino acid residue;

$X_{aa}^{10}$ is Cys if $X_{aa}^{24}$ is Cys; or $X_{aa}^{10}$ is SeCys if $X_{aa}^{24}$ is SeCys;

$X_{aa}^{11}$ is any amino acid residue;

$X_{aa}^{12}$ is a Pro, acidic, neutral, or hydrophobic amino acid residue;

$X_{aa}^{13}$ is any amino acid residue;

$X_{aa}^{14}$ is any amino acid residue;

$X_{aa}^{16}$ is a basic, neutral hydrophilic, or acidic amino acid residue, or an Ala residue;

$X_{aa}^{17}$ is a Cys if $X_{aa}^{31}$ is Cys; or $X_{aa}^{17}$ is a SeCys if $X_{aa}^{31}$ is SeCys;

$X_{aa}^{18}$ is a Cys, SeCys, or an alkyl amino acid residue;

$X_{aa}^{19}$ is any amino acid residue;

$X_{aa}^{20}$ is a Pro, Gly, basic, or neutral hydrophilic residue;

$X_{aa}^{21}$ is a basic, hydrophobic, or neutral hydrophilic amino acid residue;

$X_{aa}^{22}$ is a hydrophobic or basic amino acid residue;

$X_{aa}^{23}$ is a hydrophobic, basic, or neutral hydrophilic amino acid residue;

$X_{aa}^{24}$ is a Cys or SeCys residue;

$X_{aa}^{25}$ is a Ser, Ala, or a neutral hydrophilic amino acid residue;

$X_{aa}^{26}$ is an Ala, acidic, basic, or neutral hydrophilic amino acid residue;

$X_{aa}^{27}$ is an acidic, basic, neutral hydrophilic or hydrophobic residue;

$X_{aa}^{28}$ is an aromatic or basic amino acid residue;

$X_{aa}^{29}$ is acidic, basic, or neutral hydrophilic amino acid residue;

$X_{aa}^{30}$ is a Trp, 5-bromoTrp, 6-bromoTrp, 5-chloroTrp, 6-chloroTrp, 1-Nal, 2-Nal, or thioTrp residue;

$X_{aa}^{31}$ is a Cys or SeCys;

$X_{aa}^{33}$ is a hydrophobic or aromatic amino acid residue;

$X_{aa}^{34}$ is any amino acid residue;

$X_{aa}^{35}$ is a hydrophobic amino acid residue;

each of $X_{aa}^{36}$, $X_{aa}^{37}$, and $X_{aa}^{38}$ is independently absent or is independently a neutral, basic, or hydrophobic amino acid residue;

and wherein:

if $X_{aa}^{3}$ and $X_{aa}^{18}$ are both Cys residues, there is a disulfide bond between residue $X_{aa}^{3}$ and residue $X_{aa}^{18}$; or if $X_{aa}^{3}$ and $X_{aa}^{18}$ are both SeCys residues, there is a diselenide bond between residue $X_{aa}^{3}$ and residue $X_{aa}^{18}$;

if $X_{aa}^{10}$ and $X_{aa}^{24}$ are both Cys residues, there is a disulfide bond between residue $X_{aa}^{10}$ and residue $X_{aa}^{24}$; or if $X_{aa}^{10}$ and $X_{aa}^{24}$ are both SeCys residues, there is a diselenide bond between residue $X_{aa}^{10}$ and residue $X_{aa}^{24}$;

if $X_{aa}^{17}$ and $X_{aa}^{31}$ are both Cys residues, there is a disulfide bond between residue $X_{aa}^{17}$ and residue $X_{aa}^{31}$; or if $X_{aa}^{17}$ and $X_{aa}^{31}$ are both SeCys residues, there is a diselenide bond between residue $X_{aa}^{17}$ and residue $X_{aa}^{31}$;

the amino-terminal residue is optionally acetylated, biotinylated, 4-pentynoylated, or PEGylated; and the carboxy-terminal residue is optionally amidated.

In particular embodiments the composition of matter comprises an amino acid sequence selected from SEQ ID NOS: 3-30, 32-72, 74-134, 136-178, 180-211, 218-239, 241-305, 307-363, 366-386, 388-432, 434-474, 515-527, 532-588, 590, 591, 593-775, 777, 778, 780-788, 790-1049, and 1062-3086.

The present invention includes a composition of matter, comprising an amino acid sequence selected from SEQ ID NOS: 3-134, 136-305, 307-386, 388-474, 515-527, 532-588, 590, 591, 593-1049, and 1062-3086.

The present invention also encompasses a nucleic acid (e.g., DNA or RNA) encoding any of SEQ ID NOS: 3-134, 136-305, 307-386, 388-474, 515-527, 532-588, 590, 591, 593-1049, and 1062-3086 that does not include a non-canonical amino acid; an expression vector comprising the nucleic acid; and a recombinant host cell comprising the expression vector. The compositions of the invention provide an effective method of treating, or preventing, pain, for example acute, persistent, or chronic pain. For example, a dual inhibitor of Nav1.7 and Nav1.3 can be effective in some forms of chronic pain, particularly in cases where Nav1.7 inhibition alone is insufficient. Selectivity against off-target sodium channels, particularly those governing cardiac excitability (Nav1.5) and skeletal muscle excitability (NaV1.4), is cardinal for any systemically delivered therapeutic. This selectivity is a particularly high hurdle for a dual inhibitor. Compositions of the present invention provide such selectivity against Nav1.5 and Nav1.4. For example, the GpTx-1 peptide (SEQ ID NO:1) is a weak inhibitor of Nav1.4. Moreover, the inhibition of Nav1.4 is strongly state dependent, such that GpTx-1 exerts negligible effects on the physiological, non-inactivated states of Nav1.4. (This is a key distinction between GpTx-1 and tetrodotoxin, which has little selectivity against Nav1.4, and which inhibits equally the inactivated and non-inactivated states of Nav1.4).

Consequently, the present invention is also directed to a pharmaceutical composition or a medicament containing the inventive composition of matter, and a pharmaceutically acceptable carrier.

GpTx-1 and GpTx-1 peptide analogs are also useful as research tools. Heretofore, there have not been available specific biochemical probes for Nav1.7 or for Nav1.3, and particularly no probes for correctly folded, functional Nav1.7 in the plasma membrane of live cells. As GpTx-1 and its congeners inhibit Nav1.7/Nav1.3, they clearly bind to the channel molecule with high potency and selectivity. Labeling with fluorescent or other tracer groups at the non-active sites of GpTx-1 as defined by NMR and by residue substitution can provide research tools suitable for, but not limited to, localizing sodium channels, sorting cells that express sodium channels, and screening or panning for peptides that bind to Nav1.7 or Nav1.3.

BRIEF DESCRIPTION OF THE DRAWINGS

FIG. 1 (bottom panel) shows the activity of the isolated venom fraction (percent of control, POC) in the $Na_V1.7$ IonWorks® Quatrro (IWQ) patch clamp system-based assay. Fraction 31 (indicated with rectangular box) contained a major peak in the RP-HPLC chromatogram, exhibited >80% inhibition in the ion channel assay, and was later deconvoluted to yield GpTx-1 (SEQ ID NO:1).

*porteri* venom. The inset shows the low and mid mass ranges. The peak with an m/z ratio of 4074.9 was eventually identified as GpTx-1, but the fraction is a mixture of at least four distinct peptides.

Figure 4:
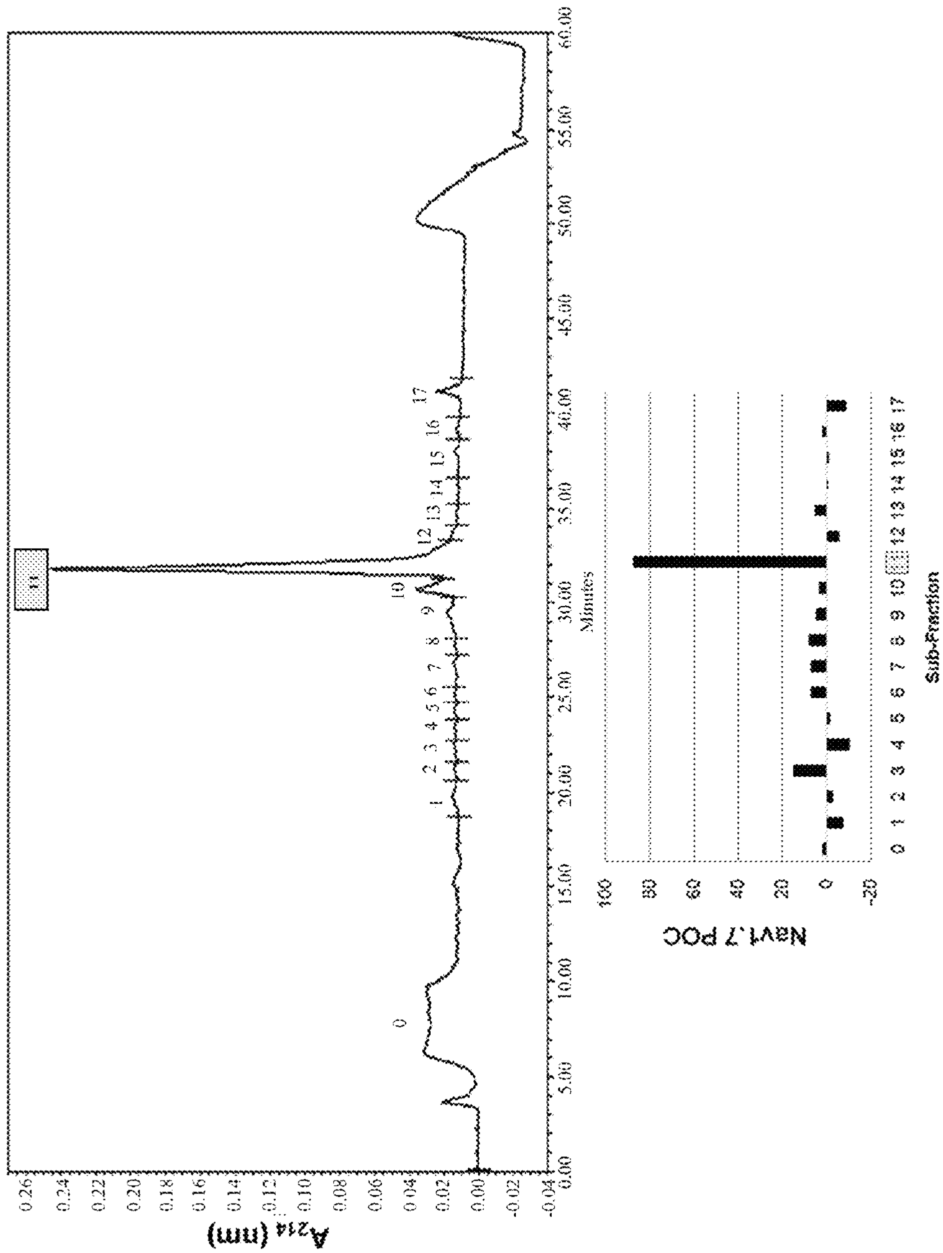

FIG. 4 (top panel) shows the RP-HPLC separation (subfractionation) of the material in fraction 31 from the initial separation of *Grammostola porteri* venom. The tick marks along the x-axis represent time slices of the sub-fractionation. FIG. 4 (bottom panel) shows the activity of the isolated subfractions (POC) in the $Na_V1.7$ IonWorks® Quatrro (IWQ) patch clamp system-based assay. The major peak in the RP-HPLC chromatogram was the most active in the $Na_V1.7$ assay and was deconvoluted to identify GpTx-1.

Figure 5:
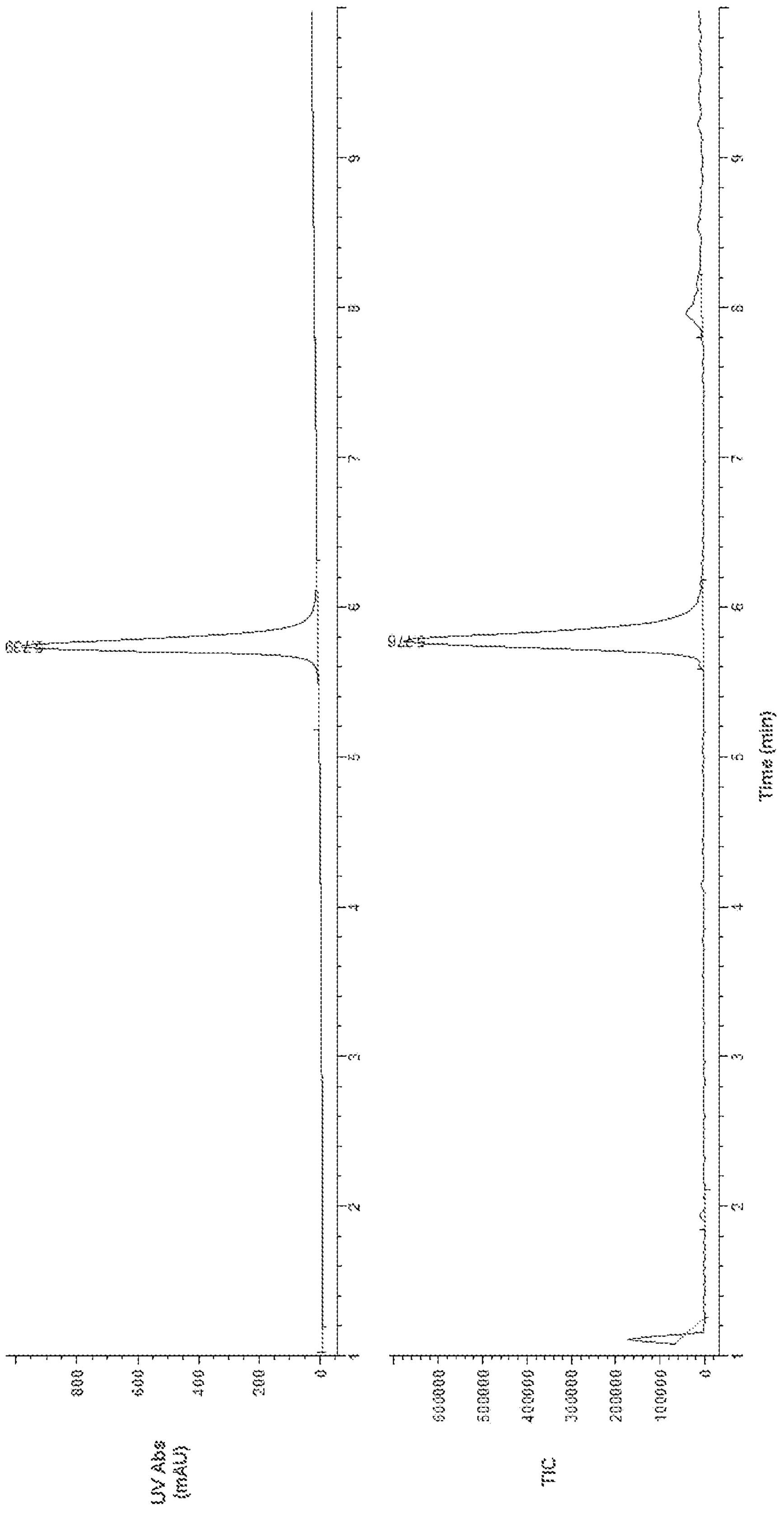

FIG. 5 shows LC-MS analysis of synthetic GpTx-1. The top panel shows the RP-HPLC chromatogram of UV absorbance at 214 nm. The bottom panel shows the total ion count (TIC) of the ESI-MS detector.

Figure 6:
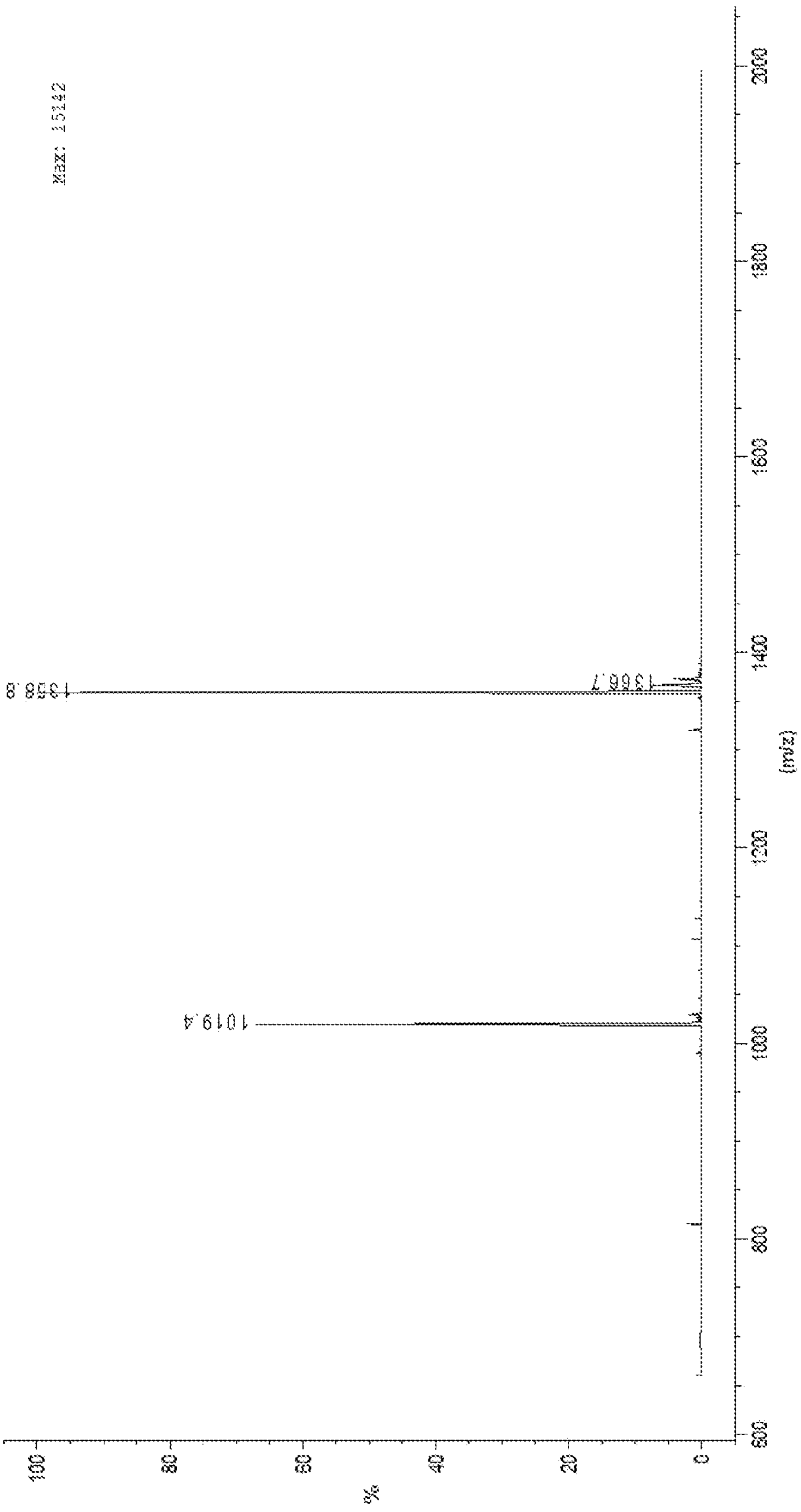

FIG. 6 shows the ESI-MS analysis of the peak with the retention time ($r_t$) of 6.75 minutes in FIG. 5. The peaks with m/z ratios of 1358.8 and 1019.4 represent the $[M+3H]^{3+}$ and $[M+3H]^{4+}$ charge states, respectively, of GpTx-1, which has a monoisotopic molecular weight of 4071.9 Da.

Figure 7:
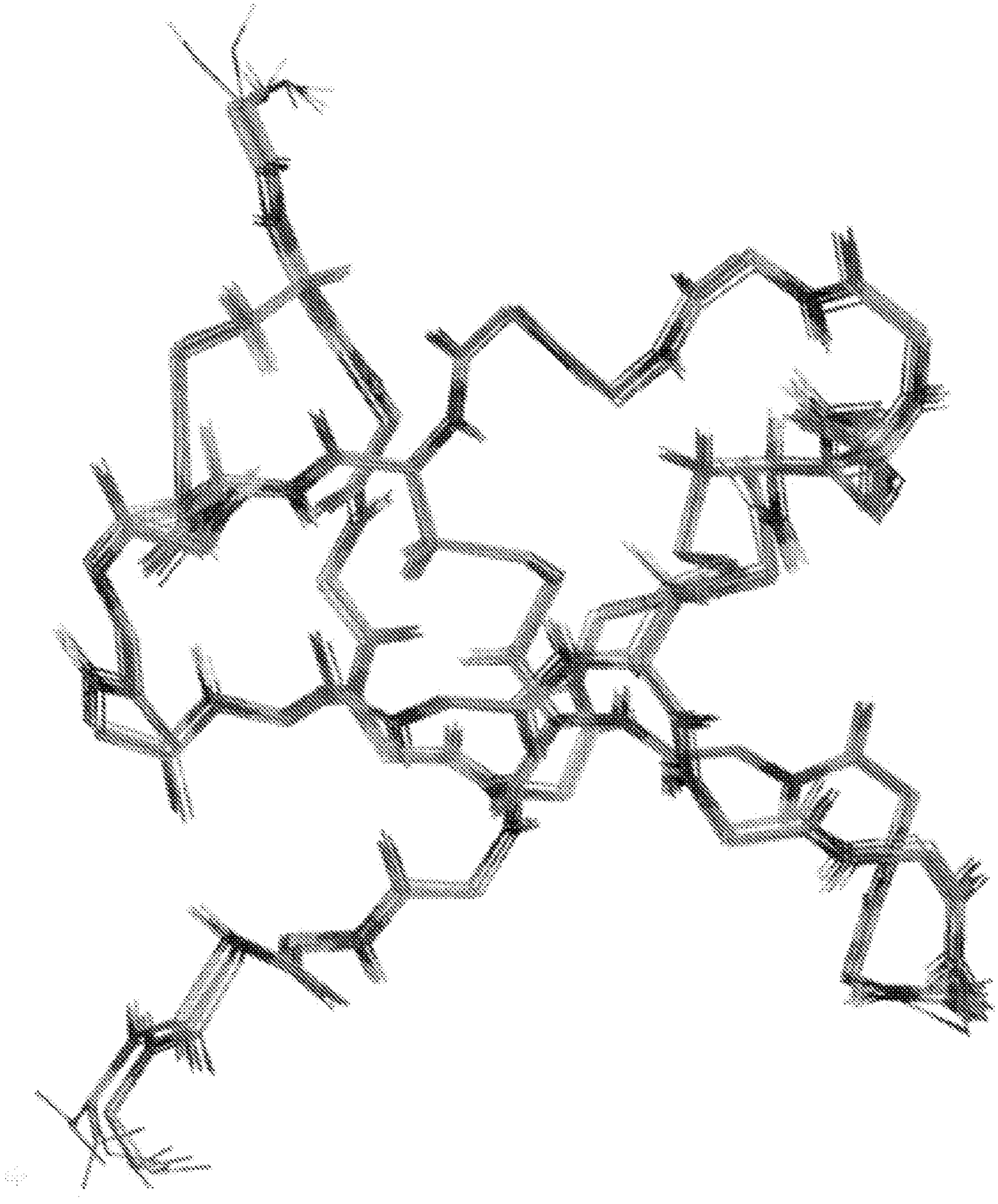

FIG. 7 shows the overlay of the peptide backbone for the 20 lowest energy conformations (RMSD=0.1±0.05 Å) from the structural determination of GpTx-1 by NMR spectroscopy.

Figure 8:
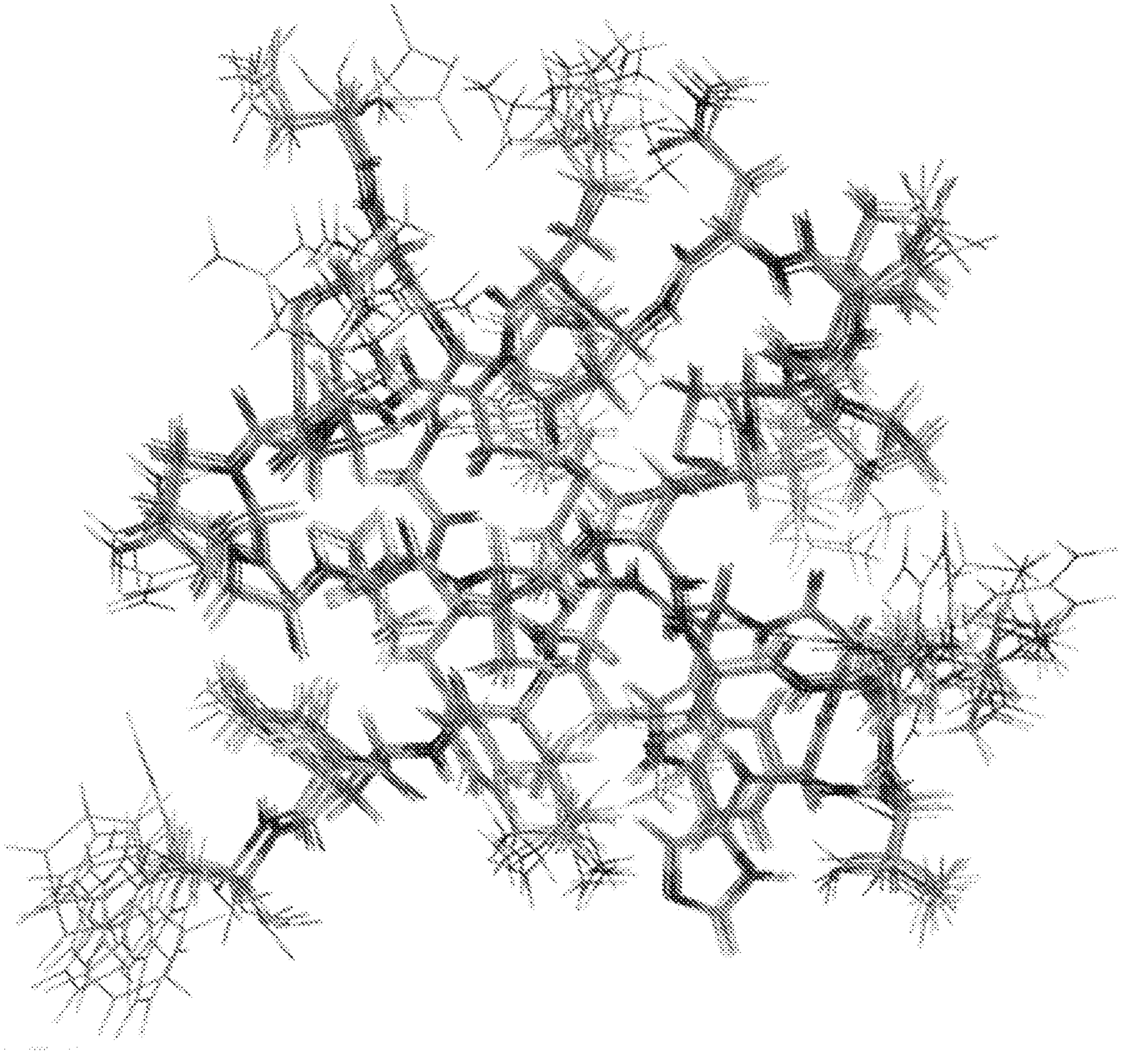

FIG. 8 shows the overlay of the peptide heavy atoms for the 20 lowest energy conformations (RMSD=0.74±0.12 Å) from the structural determination of GpTx-1 by NMR spectroscopy.

Figure 9:
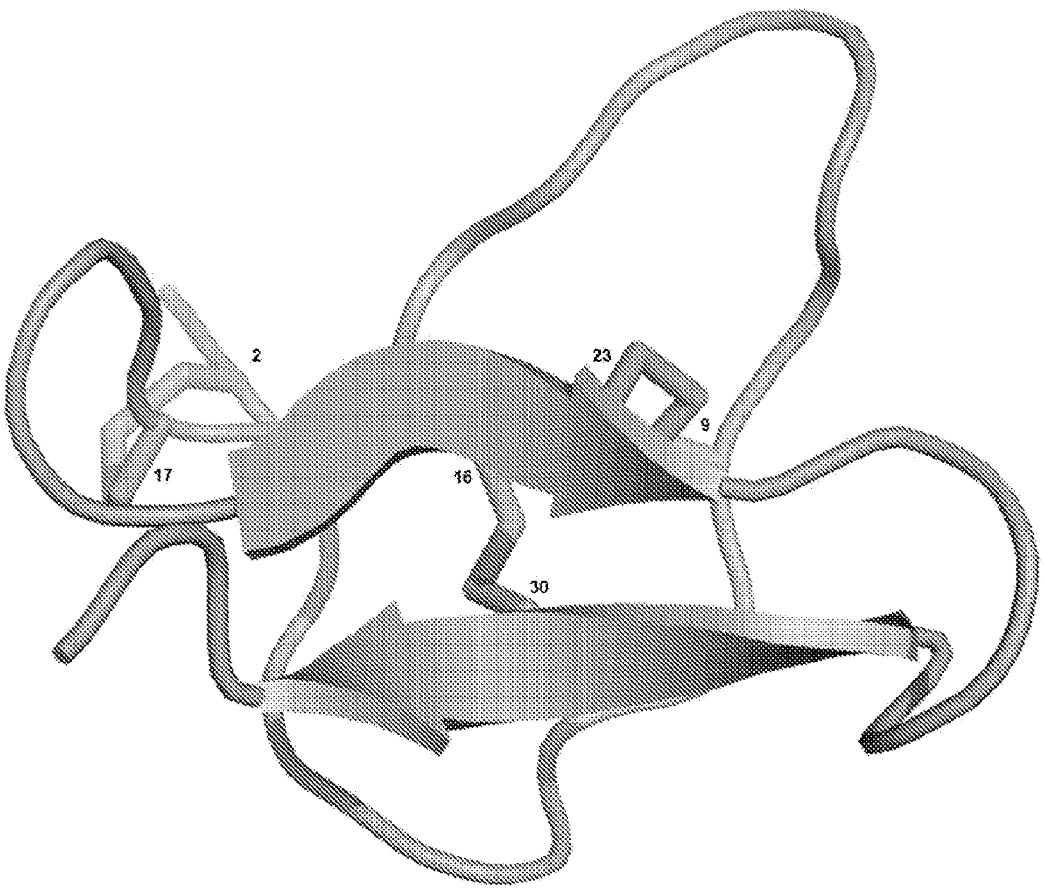

FIG. 9 shows a ribbon representation of the peptide backbone and disulfide bonds (with the numbers corresponding to the cysteine residues) from the structural determination of GpTx-1 by NMR spectroscopy.

Figure 10:
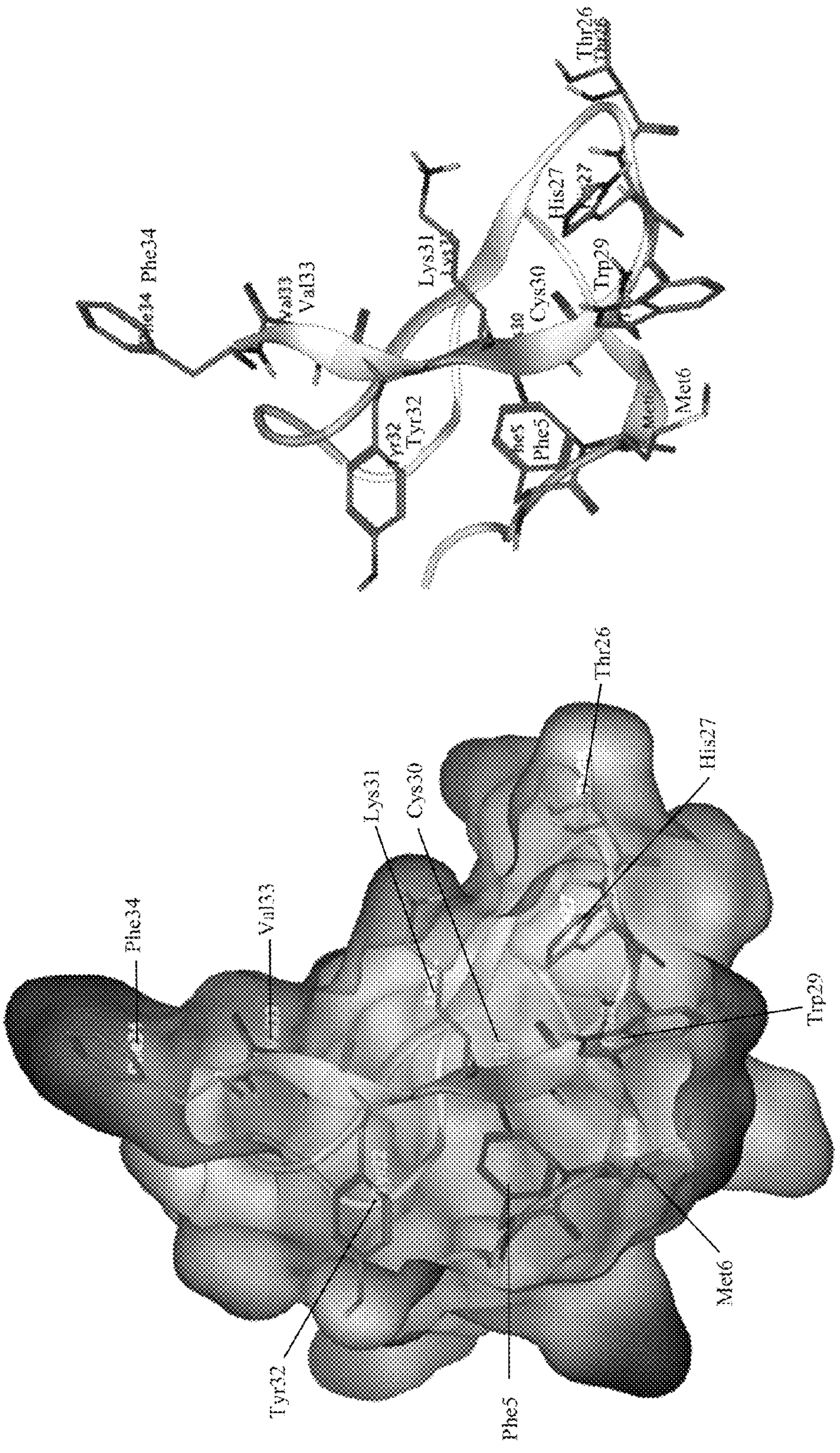

FIG. 10 shows GpTx-1 oriented with the hydrophobic and putative binding face formed by the C-terminal β-strand and residues Phe5 and Met6 oriented toward the reader. On the right, is a ribbon representation of the peptide backbone with the side chains of key residues depicted, and the left shows a partially transparent surface rendering of the molecule.

Figure 11:
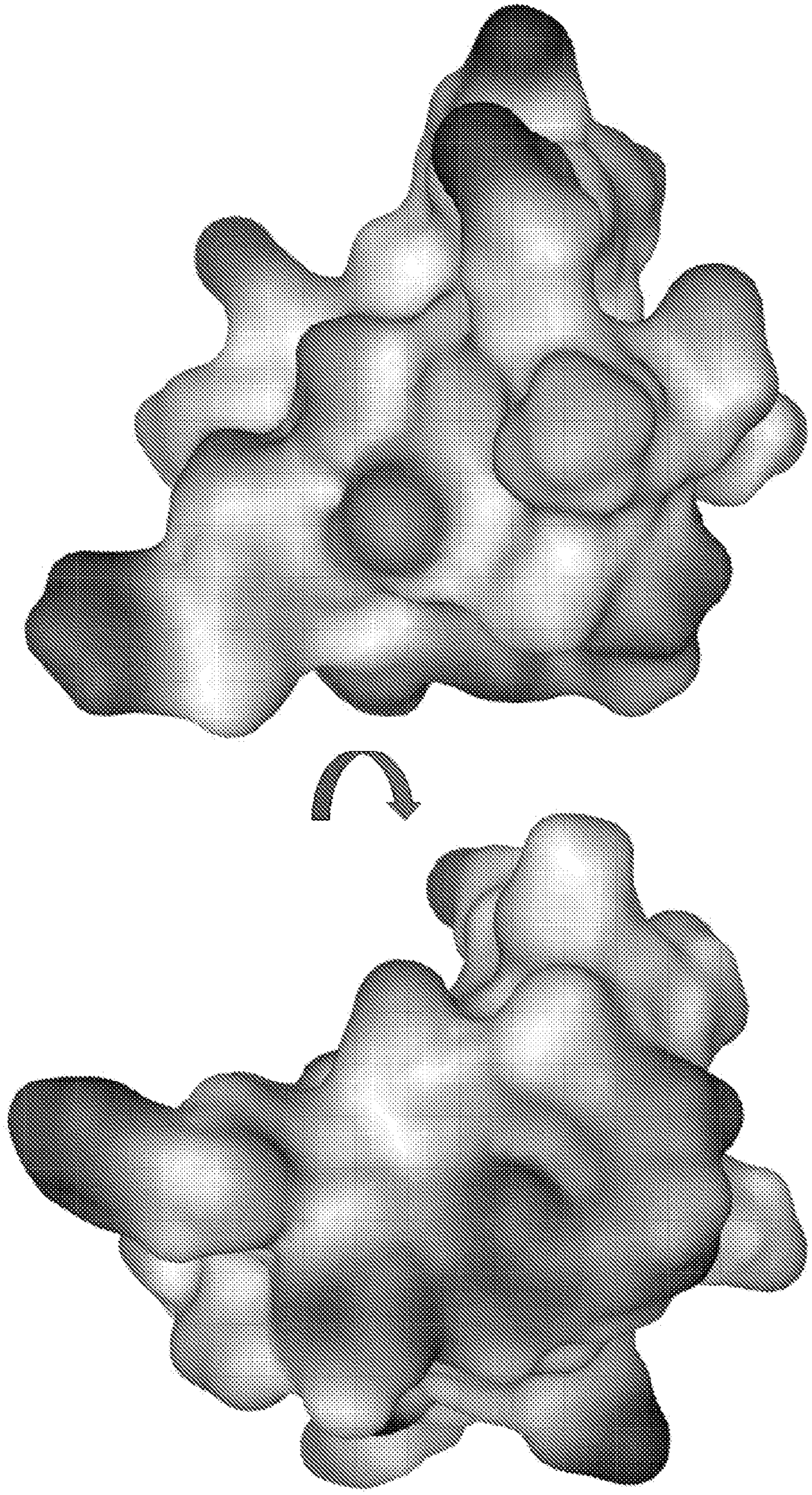

FIG. 11 (left) shows the hydrophobic and putative binding face of GpTx-1 with an opaque surface. On the right, the molecule has been rotated clockwise by 90° to show the topological contrast between the flat hydrophobic face and the hydrophilic (solvent-exposed) face of the peptide.

Figure 12A:
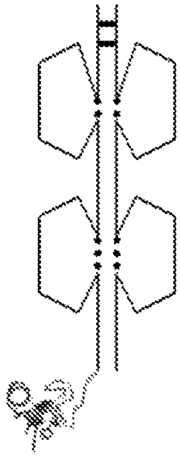
Figure 12B:
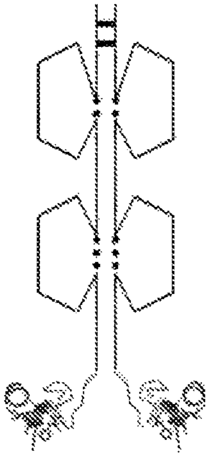
Figure 12C:
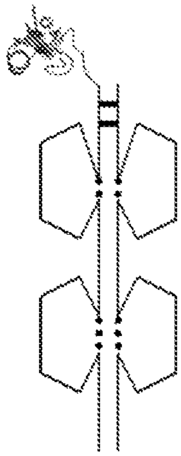
Figure 12D:
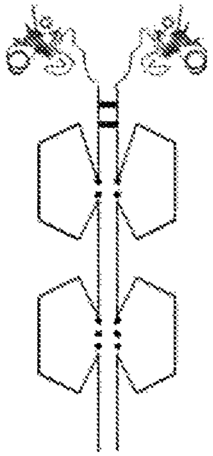
Figure 12E:
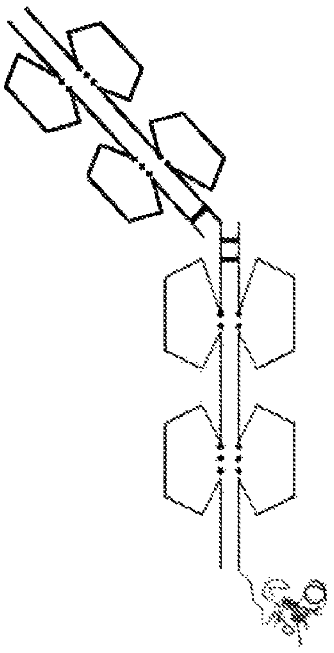
Figure 12F:
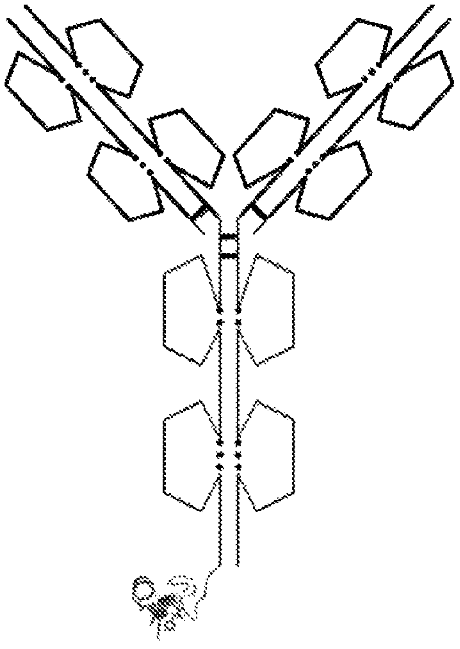
Figure 12G:
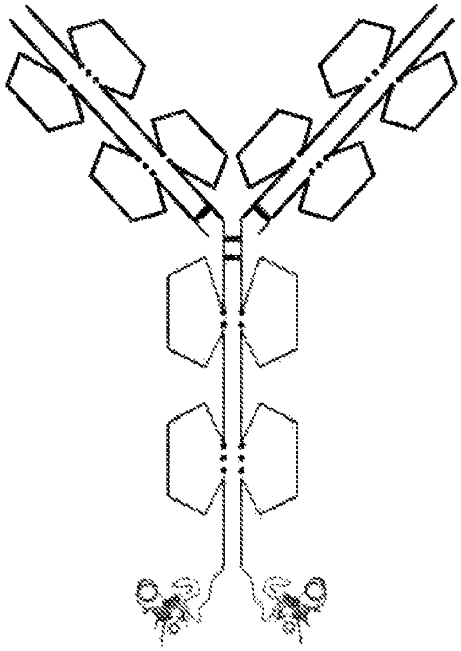
Figure 12H:
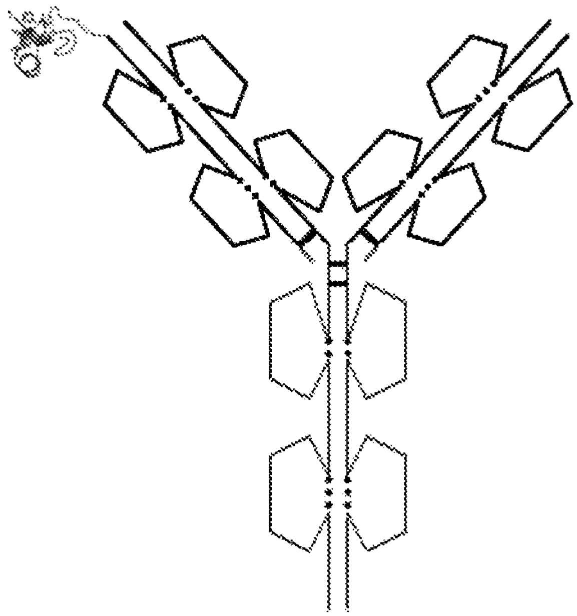
Figure 12I:
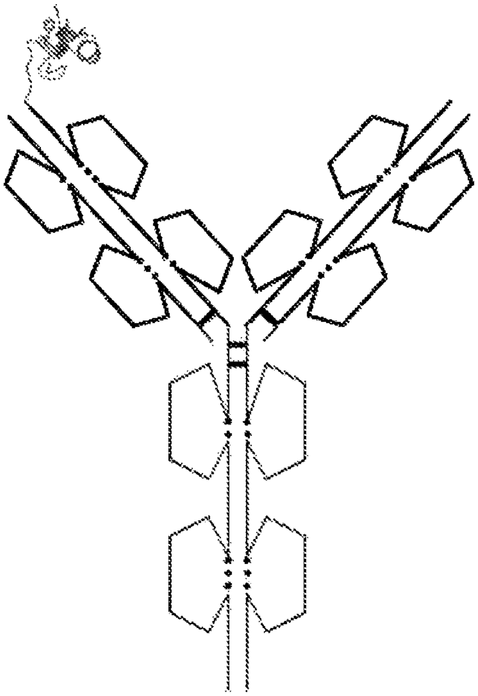
Figure 12J:
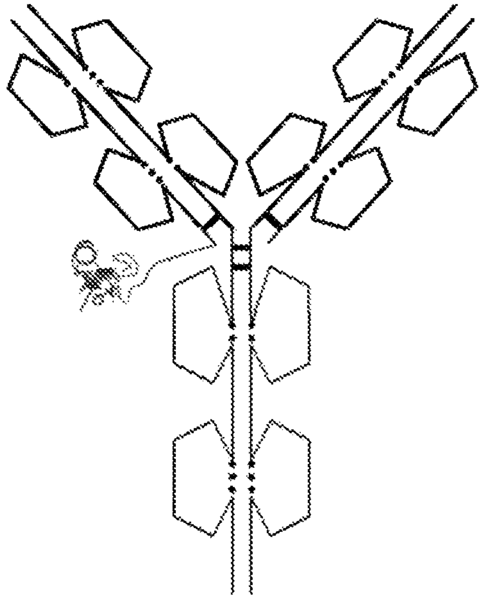
Figure 12K:
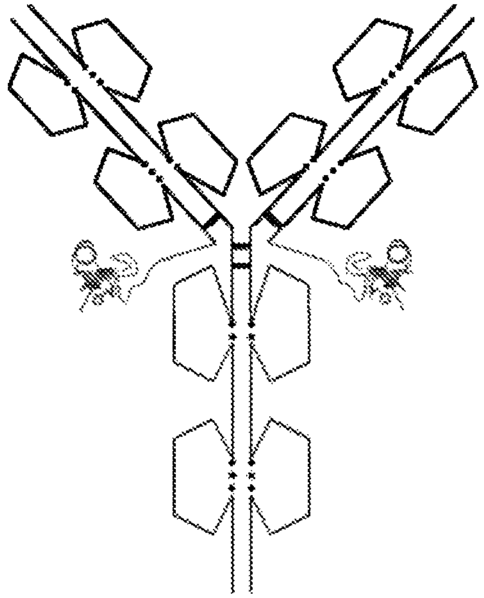
Figure 12L:
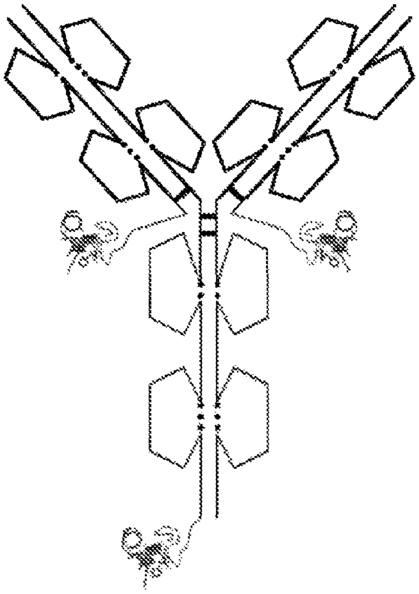
Figure 12M:
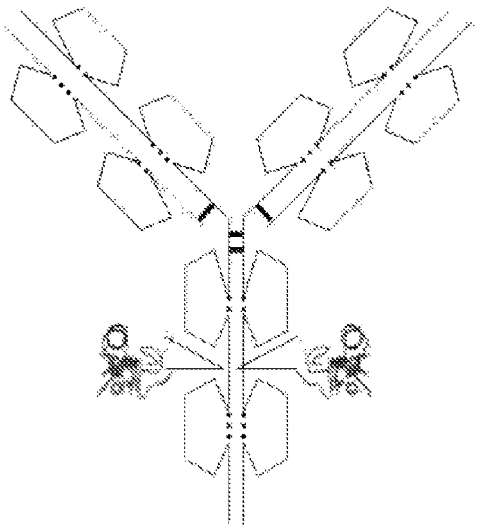
Figure 12N:
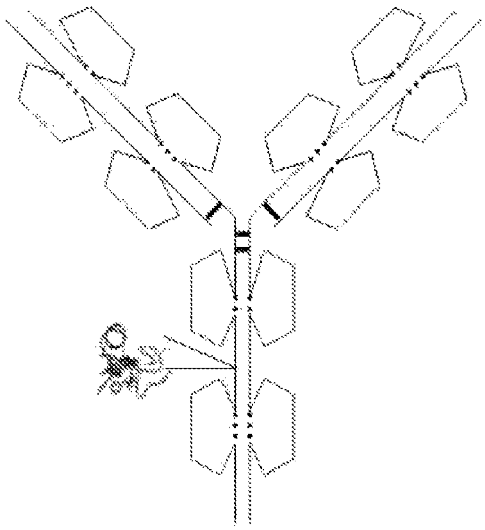

FIG. 12A-N shows schematic structures of some embodiments of a composition of the invention that include one or more units of a pharmacologically active toxin, e.g., GpTx-1, or toxin (e.g., GpTx-1) peptide analog (squiggle) fused, via an optional peptidyl linker moiety such as but not limited to L5 or L10 described herein, with one or more domains of an immunoglobulin. These schematics show a more typical IgG1, although they are intended to apply as well to IgG2s, which will have 4 disulfide bonds in the hinge and a different arrangement of the disulfide bond linking the heavy and light chain, and IgG3s and IgG4s. FIG. 12A represents a monovalent heterodimeric Fc-toxin peptide analog fusion or conjugate with the toxin peptide analog fused or conjugated to the C-terminal end of one of the immunoglobulin Fc domain monomers. FIG. 12B represents a bivalent homodimeric Fc-toxin peptide analog fusion or conjugate, with toxin peptide analogs fused to the C-terminal ends of both of the immunoglobulin Fc domain monomers. FIG. 12C represents a monovalent heterodimeric toxin peptide analog-Fc fusion or conjugate with the toxin peptide analog fused or chemically conjugated to the N-terminal end of one of the immunoglobulin Fc domain monomers. FIG. 12D represents a bivalent homodimeric toxin peptide analog-Fc fusion or conjugate, with toxin peptide analogs fused to the N-terminal ends of both of the immunoglobulin Fc domain monomers. FIG. 12E represents a monovalent heterotrimeric Fc-toxin peptide analog/Ab comprising an immunoglobulin heavy chain (HC)+immunoglobulin light chain (LC)+an immunoglobulin Fc monomer with a toxin peptide analog fused to its C-terminal end. FIG. 12 F represents a monovalent heterotetrameric (HT) antibody HC-toxin peptide analog fusion or conjugate, with a toxin peptide analog fused to the C-terminal end of one of the HC monomers. FIG. 12G represents a bivalent HT antibody Ab HC-toxin peptide analog fusion or conjugate having toxin peptide analogs on the C-terminal ends of both HC monomers. FIG. 12H represents a monovalent HT toxin peptide analog-LC Ab, with the toxin peptide analog fused to the N-terminal end of one of the LC monomers. FIG. 12I represents a monovalent HT toxin peptide analog-HC Ab, with the toxin peptide analog fused to the N-terminal end of one of the HC monomers. FIG. 12J represents a monovalent HT Ab LC-toxin peptide analog fusion or conjugate (i.e., LC-toxin peptide analog fusion or conjugate+LC+2(HC)), with the toxin peptide analog fused to the C-terminal end of one of the LC monomers. FIG. 12K represents a bivalent HT Ab LC-toxin peptide analog fusion or conjugate (i.e., 2(LC-toxin peptide analog fusion or conjugate)+2(HC)), with toxin peptide analogs fused to the C-terminal end of both of the LC monomers. FIG. 12 L represents a trivalent HT Ab LC-toxin peptide analog/HC-toxin peptide analog (i.e., 2(LC-toxin peptide analog fusion or conjugate)+HC-toxin peptide analog fusion or conjugate+HC), with the toxin peptide analogs fused to the C-terminal ends of both of the LC monomers and one of the HC monomers. FIG. 12M represents a bivalent antibody with a toxin peptide analog moiety inserted into an internal loop of the immunoglobulin Fc domain of each HC monomer. FIG. 12N represents a monovalent antibody with a toxin peptide analog moiety inserted into an internal loop of the immunoglobulin Fc domain of one of the HC monomers. Dimers or trimers will form spontaneously in certain host cells upon expression of a deoxyribonucleic acid (DNA) construct encoding a single chain. In other host cells, the cells can be placed in conditions favoring formation of dimers/trimers or the dimers/trimers can be formed in vitro. If more than one HC monomer, LC monomer, or immunoglobulin Fc domain monomer is part of a single embodiment, the individual monomers can be, if desired, identical or different from each other.

Figure 13A:
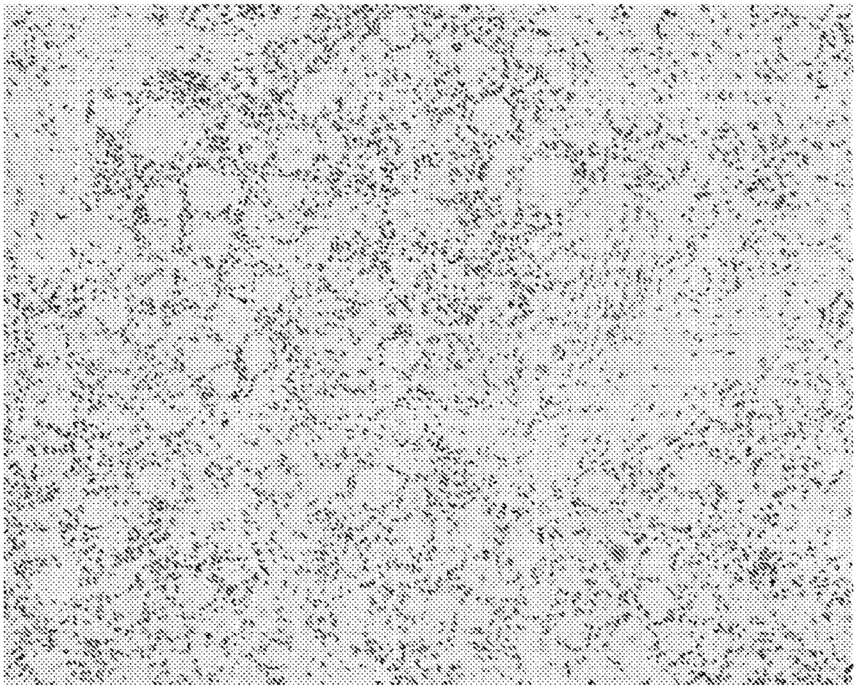
Figure 13B:
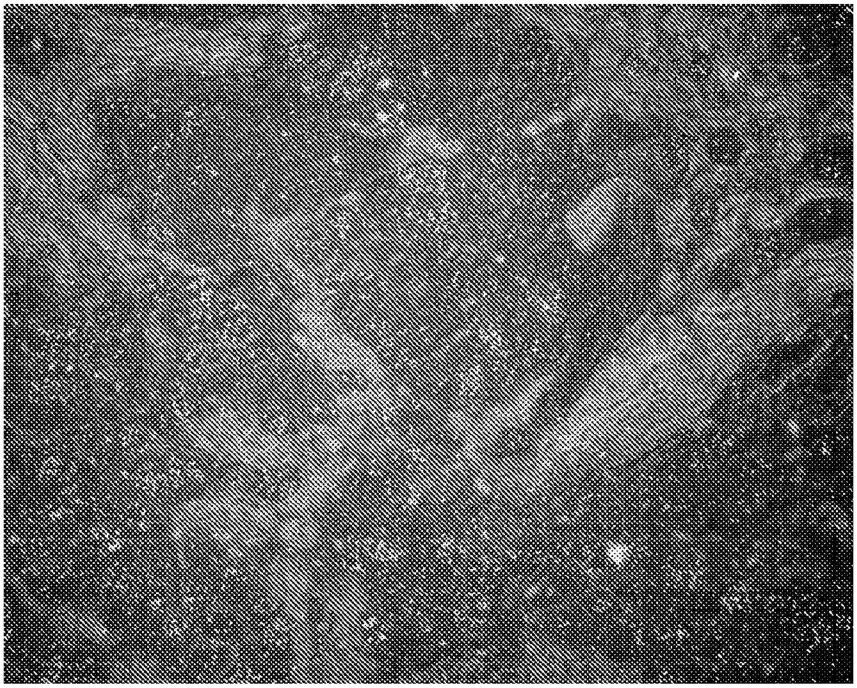
Figure 13C:
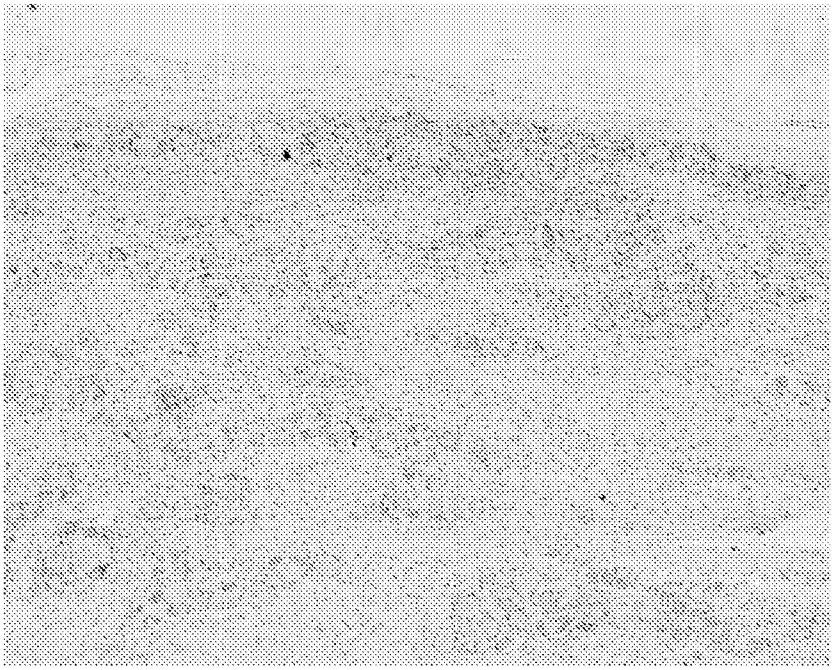
Figure 13D:
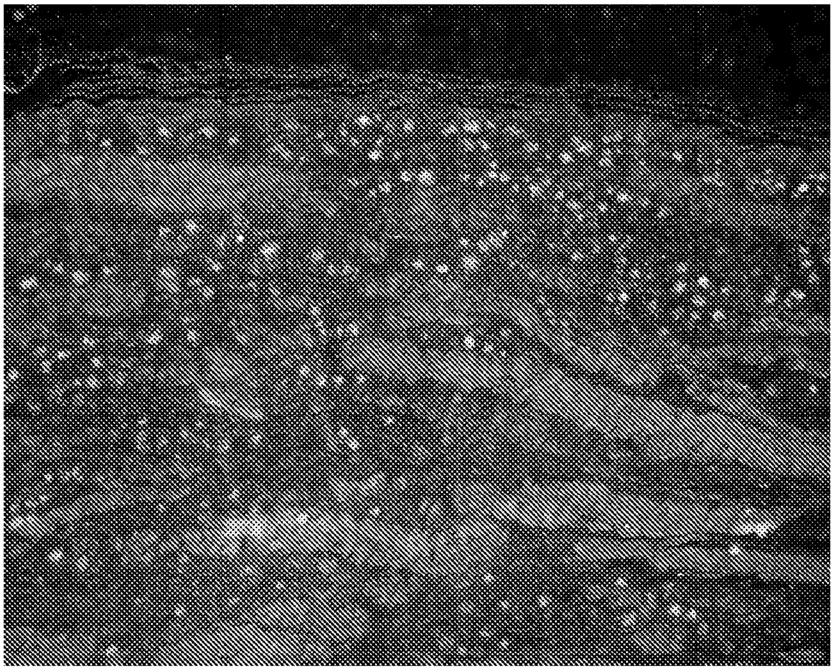
Figure 13E:
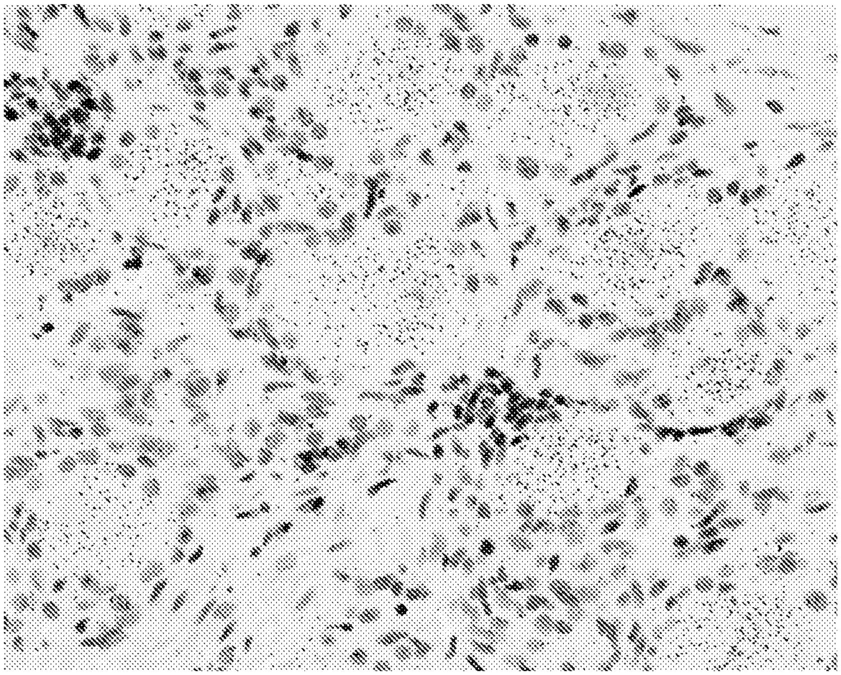
Figure 13F:
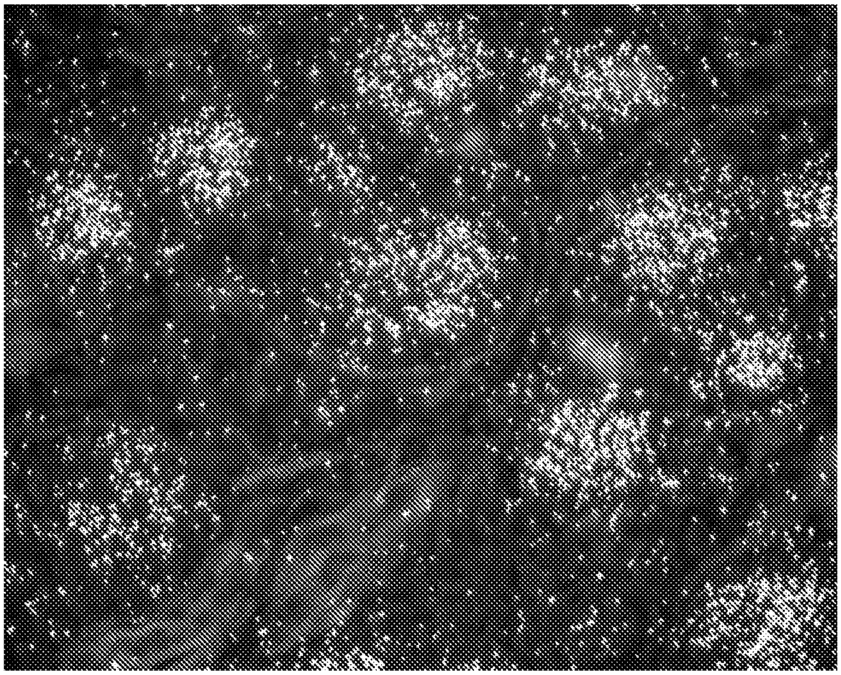

FIG. 13A-F illustrates in situ hybridization studies detecting expression of $Na_V1.7$ message RNA in human trigeminal ganglia (FIG. 13 A-B) and in human dorsal root ganglia (FIG. 13C-F). FIG. 13A, FIG. 13C, FIG. 13E show Hematoxylin and Eosin (H & E) stained cells; FIG. 13B, FIG. 13D, and FIG. 13F show expression of $Na_V1.7$ via hybridization of $^{33}P$-labeled antisense probe as blue dots. $Na_V1.7$-specific staining also was detected in myenteric plexes of stomach and small intestine. No $Na_V1.7$-specific staining was detected in human cerebellum, cerebral cortex, adrenal medulla, or pituitary, and only light staining was detected in hypothalamic nuclei. Staining from spinal cord was restricted to light staining in ventral motor areas and to spinal ependyma (epithelial cells lining the central canal). All staining was done under RNAse-free conditions on formalin-fixed, paraffin-embedded tissue. Probe was verified specific for $Na_V1.7$ by verifying a positive signal on HEK-293T cell lines expressing cloned human $Na_V1.7$ and a lack of signal on cell lines expressing any of the following sodium channels: $hNa_V1.1$ (HEK-293T), $hNa_V1.2$ (CHO), $hNa_V1.3$ (CHO), $hNa_V1.4$ (HEK-293T), $hNa_V1.5$ (HEK-293T), $hNa_V1.6$ (HEK-293T), $rNa_V1.3$ (HEK-293T), and on the parental 293T cell lines.

Figures 14A, 14B, 14C:
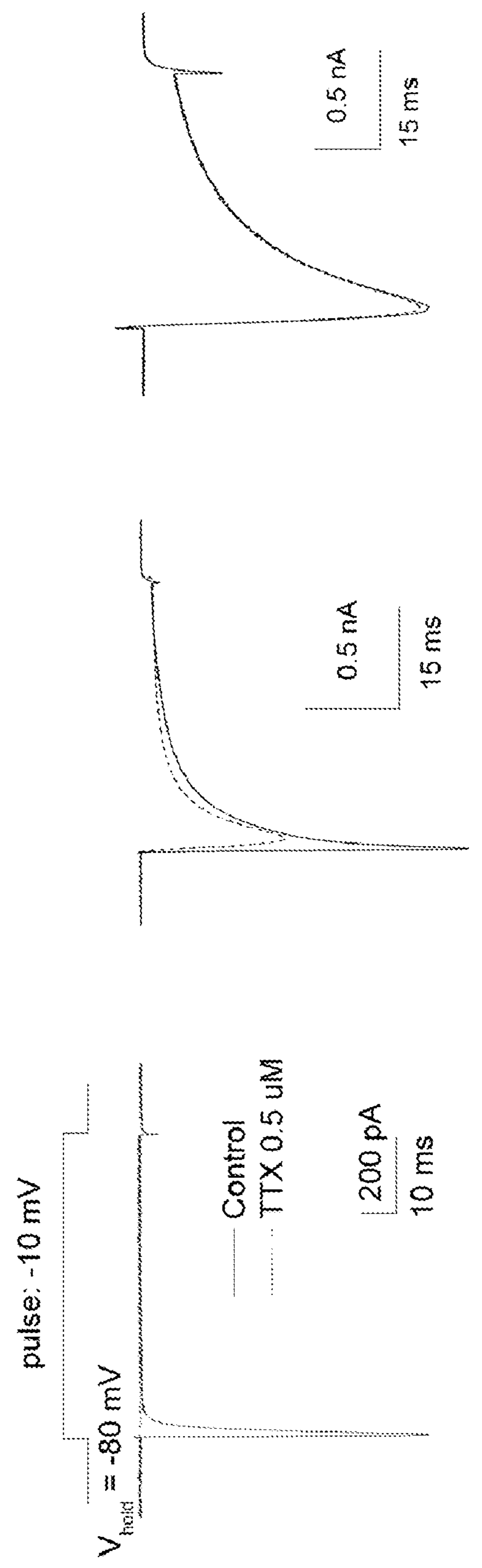
Figure 14E:
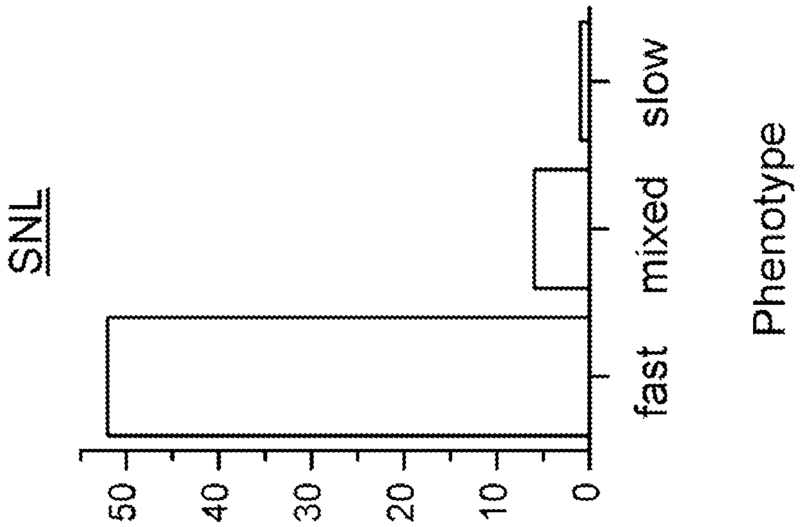
Figure 14D:
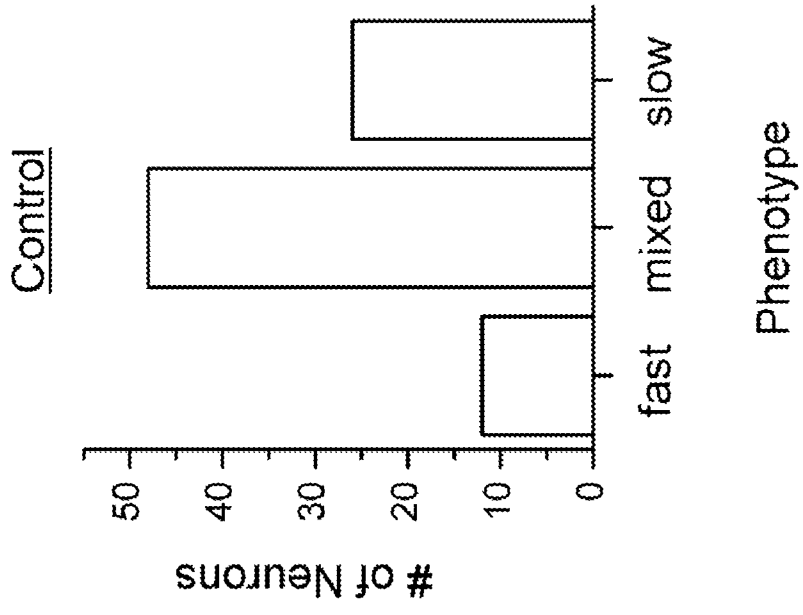

FIG. 14A-E shows that individual neurons acutely isolated from rat sensory ganglia express a heterogeneous population of sodium currents. Individual neurons expressed either fast, tetrodotoxin-sensitive sodium currents (likely $Na_V$1.7 and $Na_V$1.3), slow, tetrodotoxin-resistant sodium currents (likely $Na_V$1.8), or a mixed population (no one current type encodes>90% of the total sodium current). FIG. 14A-C show examples of a neuron expressing fast TTX-S (FIG. 14A), mixed (FIG. 14B), or slow TTX-R (FIG. 14C) sodium currents. FIG. 14D-E illustrate that neurons isolated from sensory ganglia of rats that have undergone spinal nerve ligation ("SNL") surgery (FIG. 14E) express a far greater proportion of fast TTX-S currents than control rats (FIG. 14D).

Figures 15A, 15B:
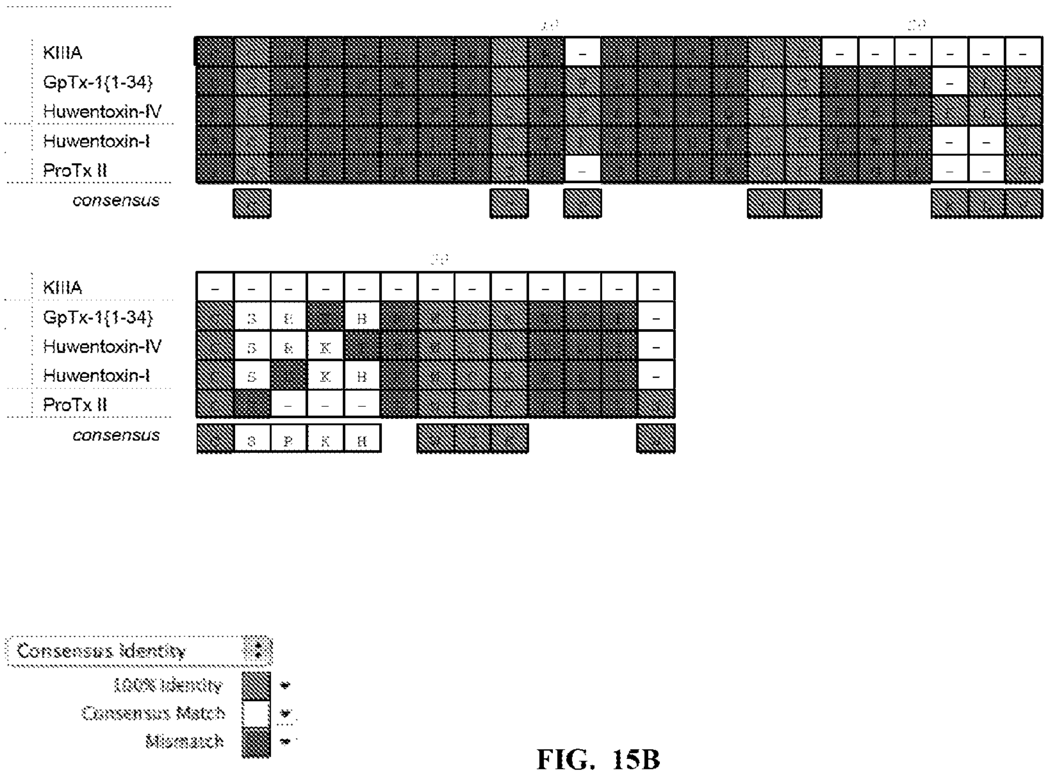

FIG. 15A-B shows sequence alignments of KIIIA (SEQ ID NO:530), GpTx-1(1-34) (SEQ ID NO:1), Huwentoxin-IV (SEQ ID NO:528), Huwentoxin-I (SEQ ID NO:529), and ProTx II (SEQ ID NO:531).

Figure 16:
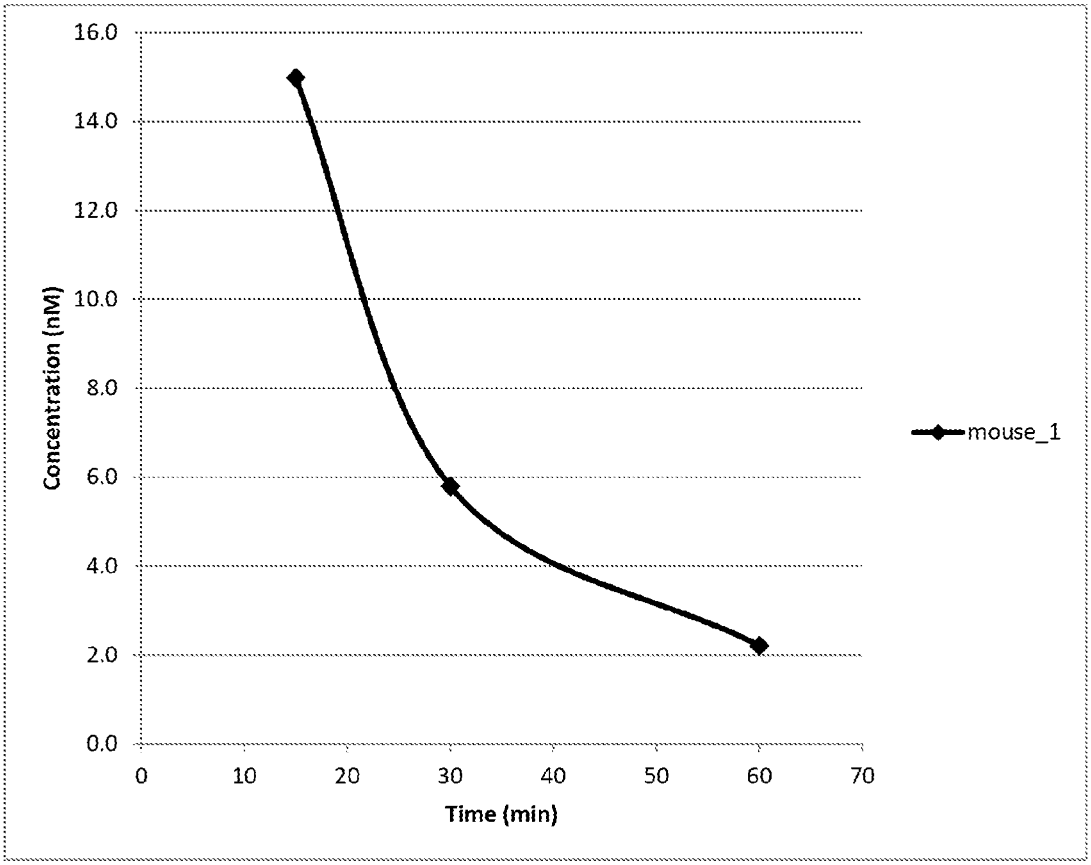

FIG. 16 shows the concentration-time profile of GpTx-1 in mouse plasma following a 1 mg/kg subcutaneous ("s.c.") administration. The GpTx-1 concentration was below the lower limit of quantitation in two of the three animals, and the profile could not be obtained.

Figure 17A:
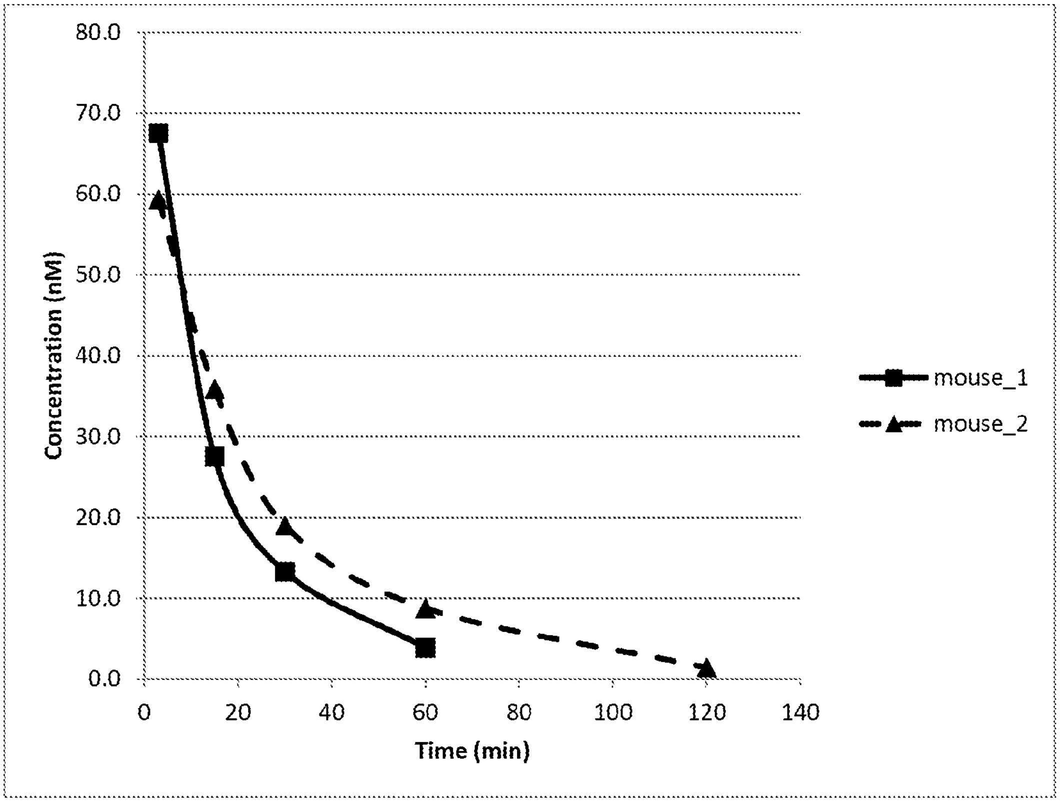

FIG. 17A shows the concentration-time profile of [Ala5]GpTx-1 (SEQ ID NO:22) in plasma from two mice following a 1 mg/kg intravenous ("i.v.") administration. (Exposures from a third mouse were lower than the quantitation limit, and the profile could not be obtained.)

Figure 17B:
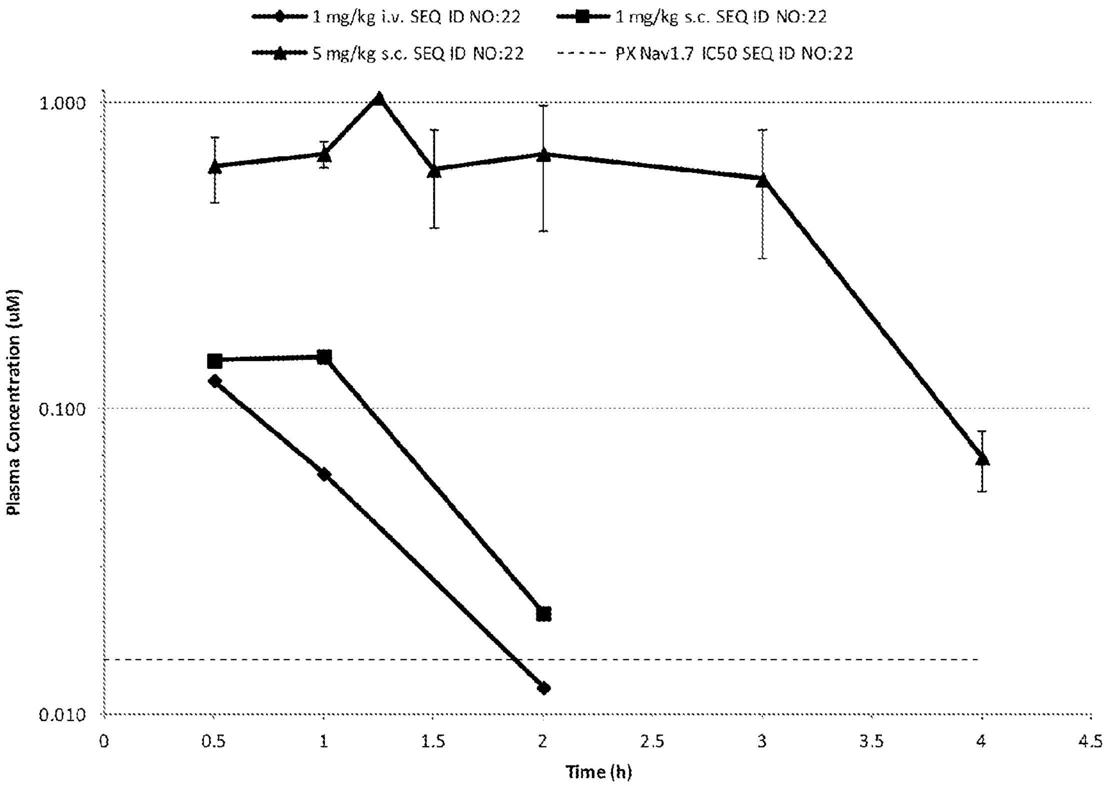

FIG. 17B shows the average plasma concentration-time profiles of [Ala5]GpTx-1 (SEQ ID NO:22) in plasma from mice following a 5 mg/kg s.c. dose (n=3), a 1 mg/kg s.c. dose (n=2), and a 1 mg/kg intravenous (i.v.) dose (n=2). For the 5 mg/kg dose, peptide concentrations in the plasma were sustained at about 0.6 μM, approximately 40-fold over the in vitro Nav1.7 $IC_{50}$ as determined by PatchXpress® (PX) patch clamp system, for 3 h.

Figure 18:
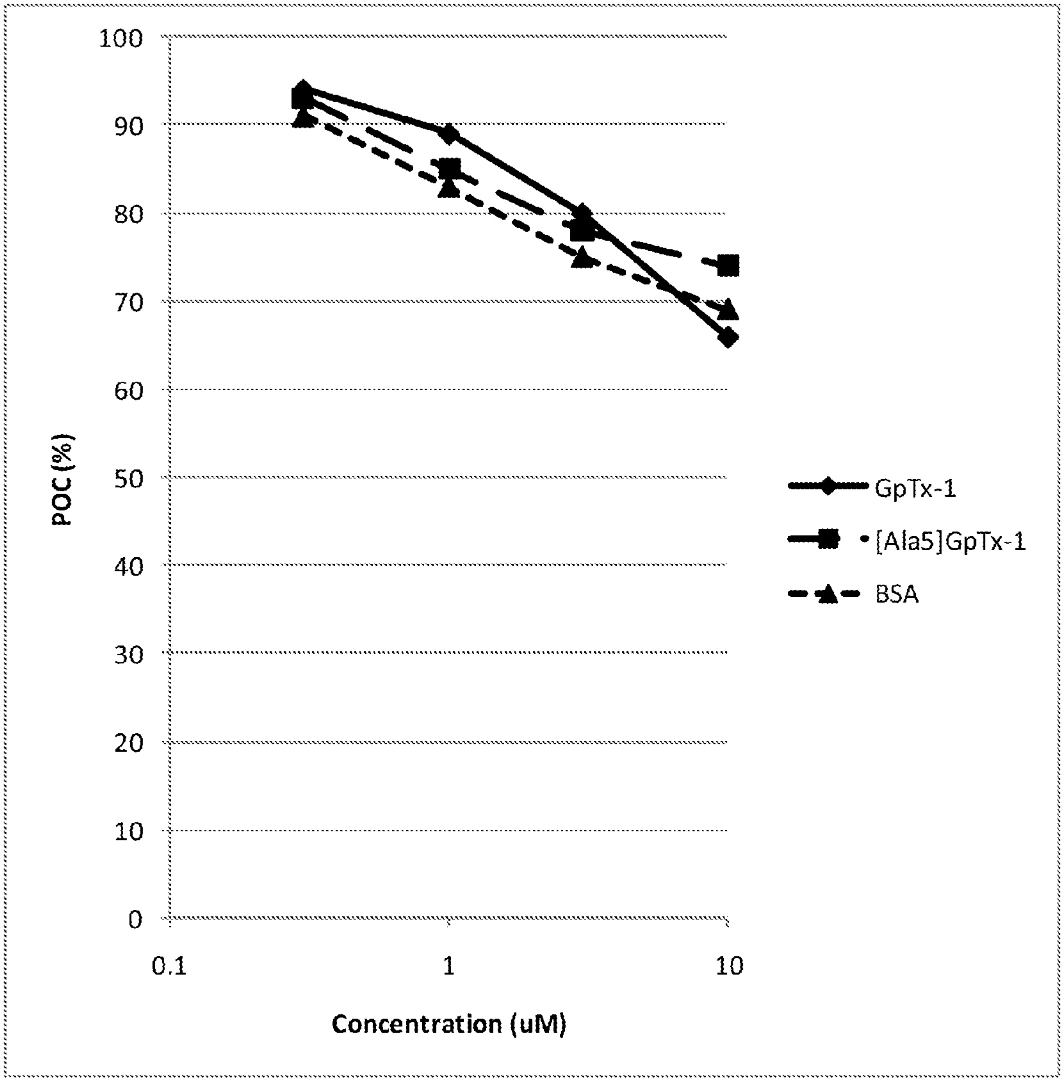

FIG. 18 shows the dose response relationship for GpTx-1 (SEQ ID NO:1; n=7), [Ala5]GpTx-1 (SEQ ID NO:22; n=8), and BSA control tested against hERG. The $IC_{50}$ value for both compounds was >10 μM.

Figure 19A:
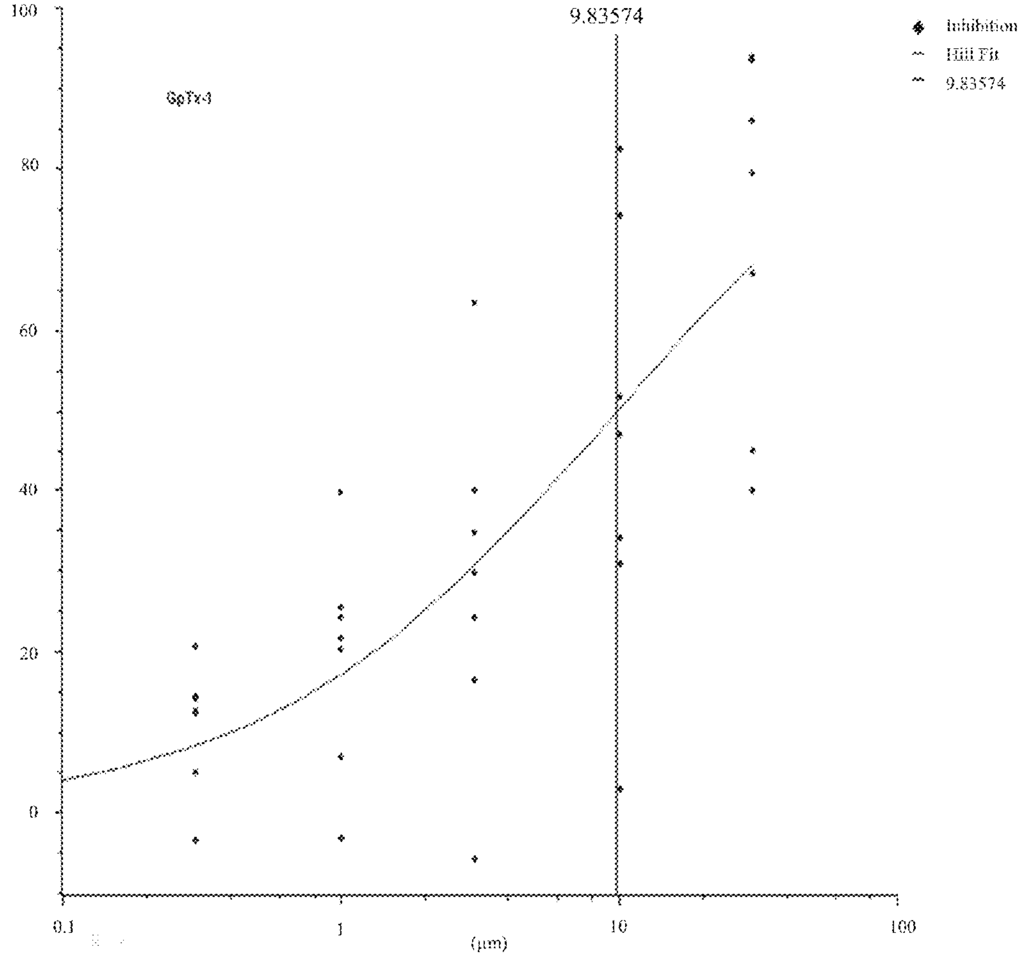

FIG. 19A shows the dose response relationship for GpTx-1 (SEQ ID NO:1; n=7) tested against hNav1.5. The $IC_{50}$ value for GpTx-1 was 9.8 μM.

Figure 19B:
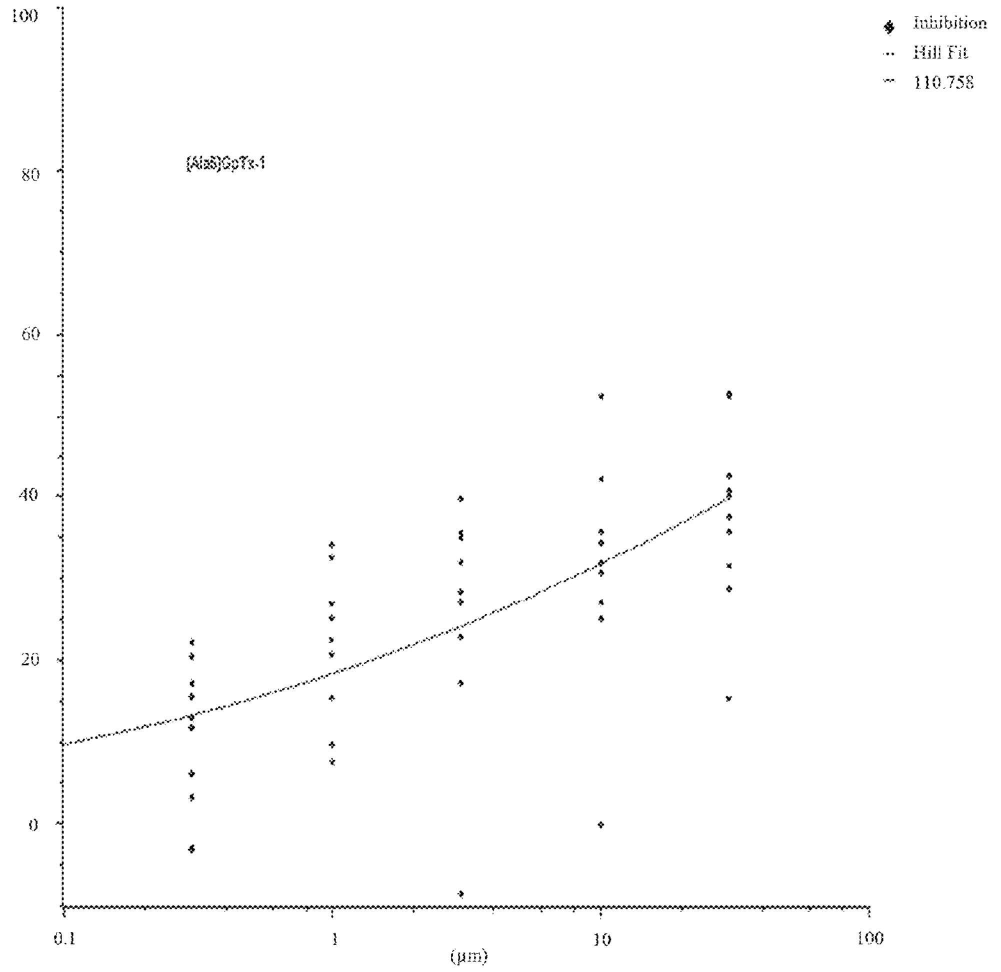

FIG. 19B shows the dose response relationship for [Ala5]GpTx-1 (SEQ ID NO:22, n=9) tested against hNav1.5. The $IC_{50}$ value for [Ala5]GpTx-1 was >30 μM.

Figure 20:
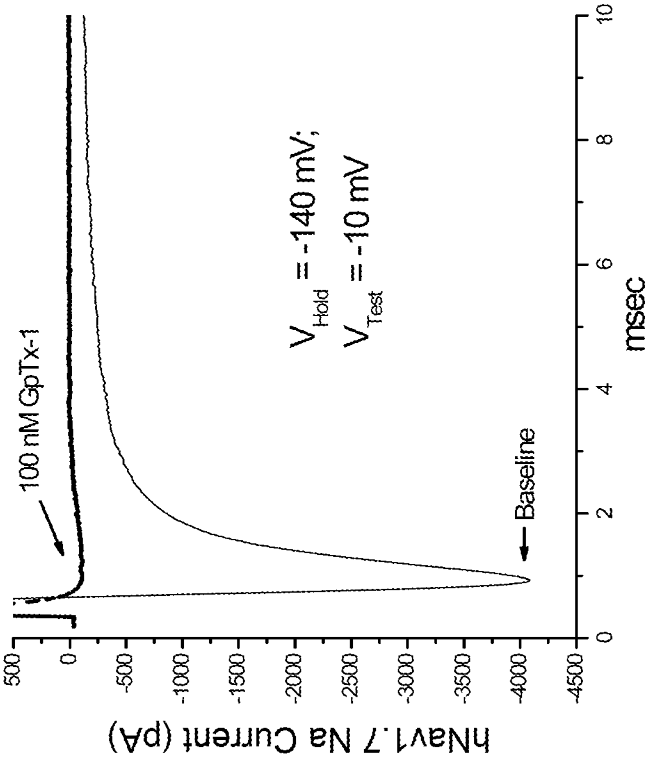

FIG. 20 shows the effect of GpTx-1 (SEQ ID NO:1) on hNav1.7 channels. Cells were held at −140 mV and peak inward hNav1.7 currents were measured at −10 mV. "Baseline" trace shows hNav1.7 current before GpTx-1, and '100 nM GpTx-1' trace shows hNav1.7 current after GpTx-1 addition.

Figure 21:
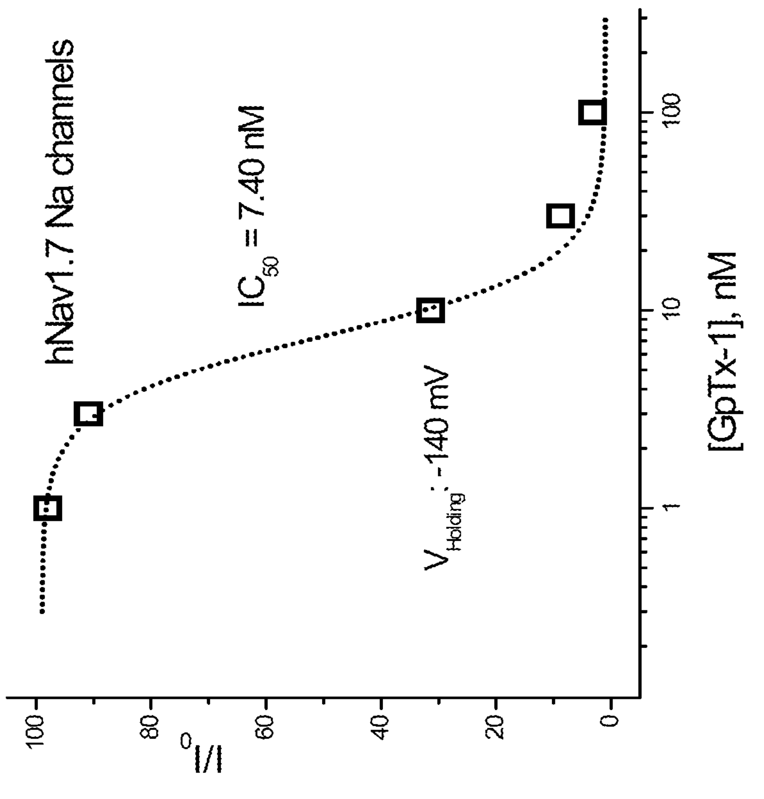

FIG. 21 shows a dose-response curve of GpTx-1 (SEQ ID NO:1) against hNav1.7 channels. Peak inward hNav1.7 currents were measured at −10 mV in the presence of increasing concentrations of GpTx-1; cells were held at −140 mV. Currents were normalized with 100 representing Nav1.7 current with no peptide addition and 0 representing Nav1.7 current following complete block. The $IC_{50}$ of GpTx-1 against hNav1.7 channels was 7.40 nM.

Figure 22:
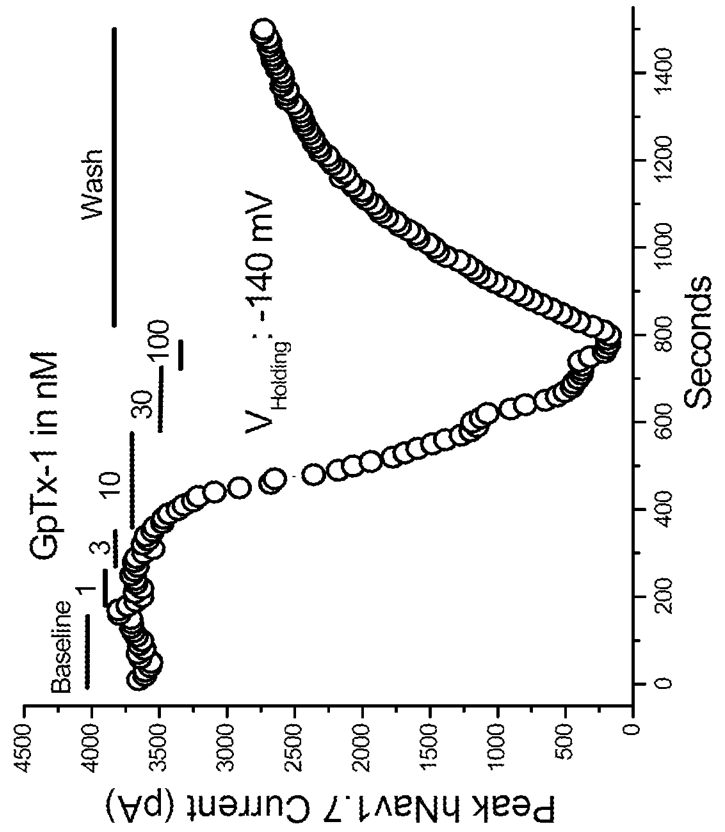

FIG. 22 shows a time course of increasing concentrations of GpTx-1 (SEQ ID NO:1) against hNav1.7 channels. Peak inward hNav1.7 currents were measured at −10 mV every 10 seconds in the presence of increasing concentrations of GpTx-1; cells were held at a −140 mV. "Baseline" indicates hNav1.7 current in the absence of GpTx-1 and "Wash" indicates hNav1.7 current following removal of GpTx-1.

Figure 23:
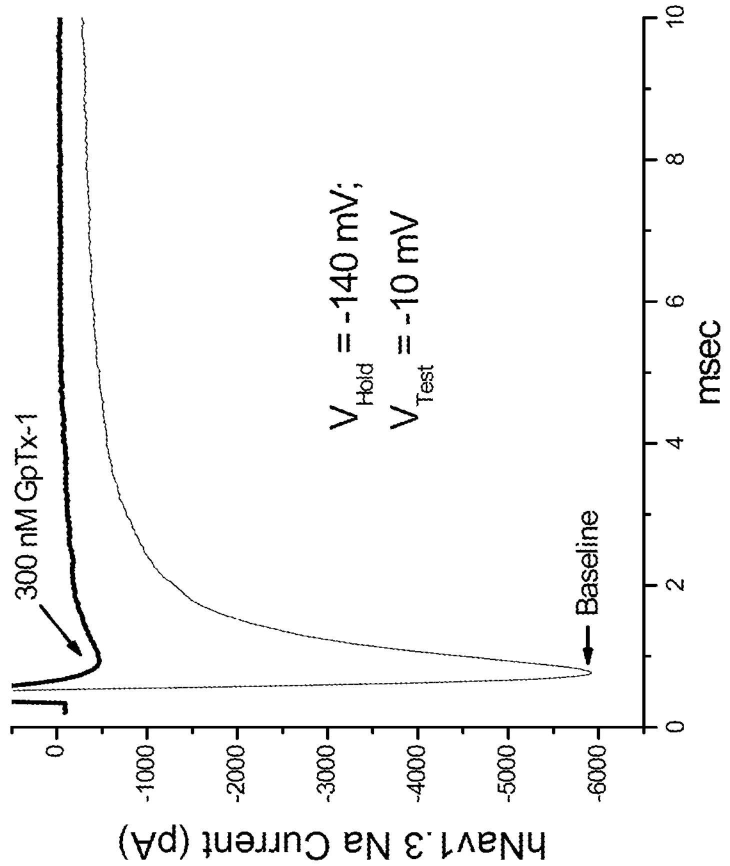

FIG. 23 shows the effect of GpTx-1 (SEQ ID NO:1) on hNav1.3 channels. Cells were held at −140 mV and peak inward hNav1.3 currents were measured at −10 mV. "Baseline" trace shows hNav1.3 current before GpTx-1, and '300 nM GpTx-1' trace shows hNav1.3 current after GpTx-1 addition.

Figure 24:
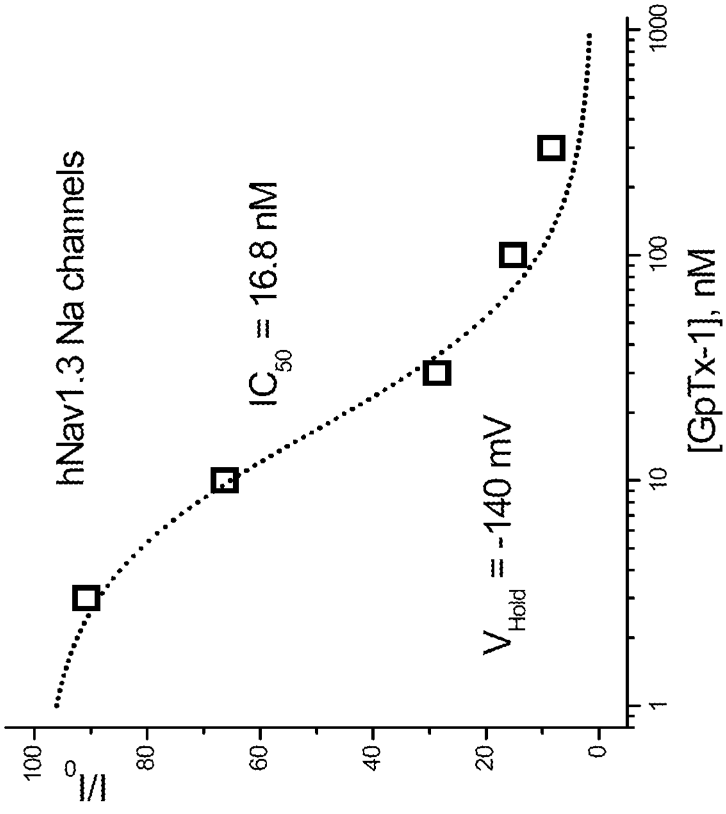

FIG. 24 shows a dose-response curve of GpTx-1 (SEQ ID NO:1) against hNav1.3 channels. Peak inward hNav1.3 currents were measured at −10 mV in the presence of increasing concentrations of GpTx-1; cells were held at −140 mV. Currents were normalized with 100 representing Nav1.3 current with no peptide addition and 0 representing Nav1.3 current following complete block. The $IC_{50}$ of GpTx-1 against hNav1.3 channels was 16.8 nM.

Figure 25:
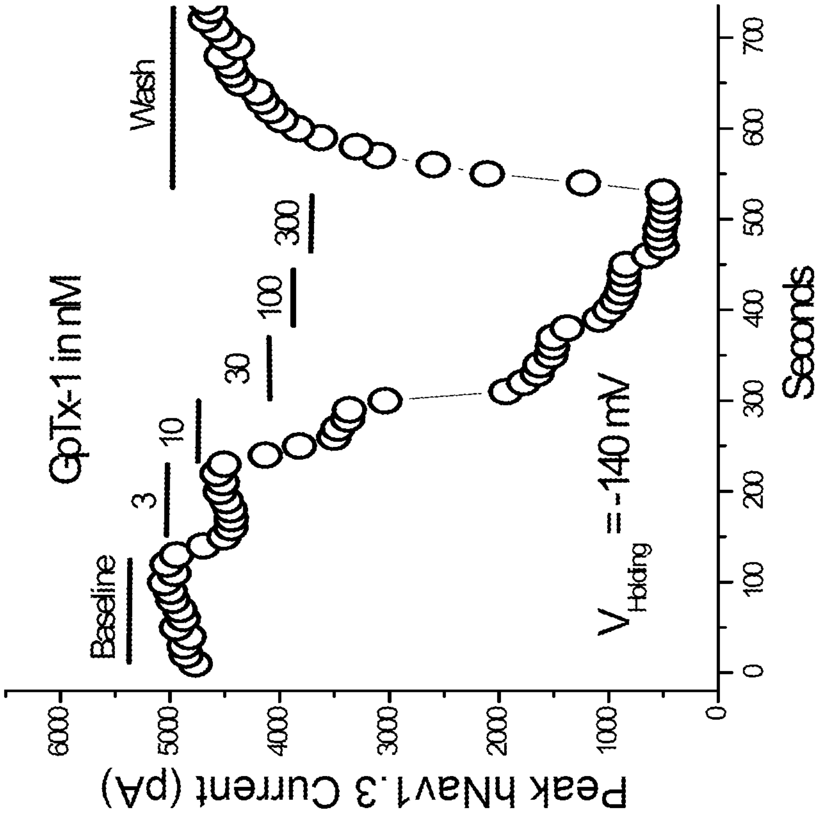

FIG. 25 shows a time course of increasing concentrations of GpTx-1 (SEQ ID NO:1) against hNav1.3 channels. Peak inward hNav1.3 currents were measured at −10 mV every 10 seconds in the presence of increasing concentrations of GpTx-1; cells were held at a −140 mV. "Baseline" indicates hNav1.3 current in the absence of GpTx-1 and "Wash" indicates hNav1.3 current following removal of GpTx-1.

Figure 26:
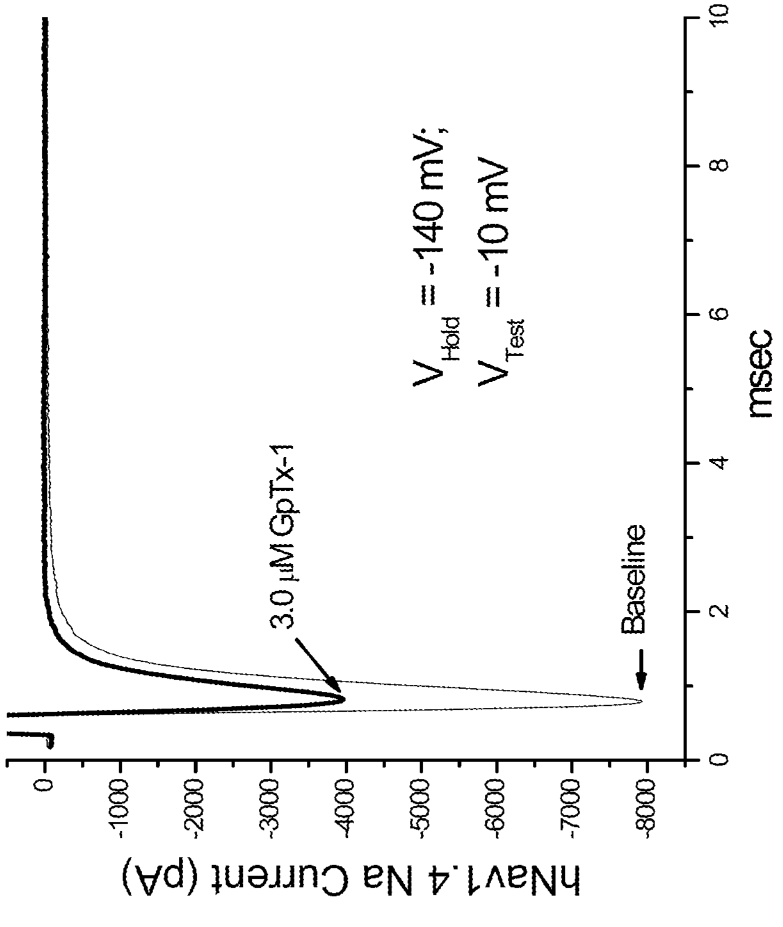

FIG. 26 shows the effect of GpTx-1 (SEQ ID NO:1) on hNav1.4 channels. Cells were held at −140 mV and peak inward hNav1.4 currents were measured at −10 mV. "Baseline" trace shows hNav1.4 current before GpTx-1, and '3 μM GpTx-1' trace shows hNav1.4 current after GpTx-1 addition.

Figure 27:
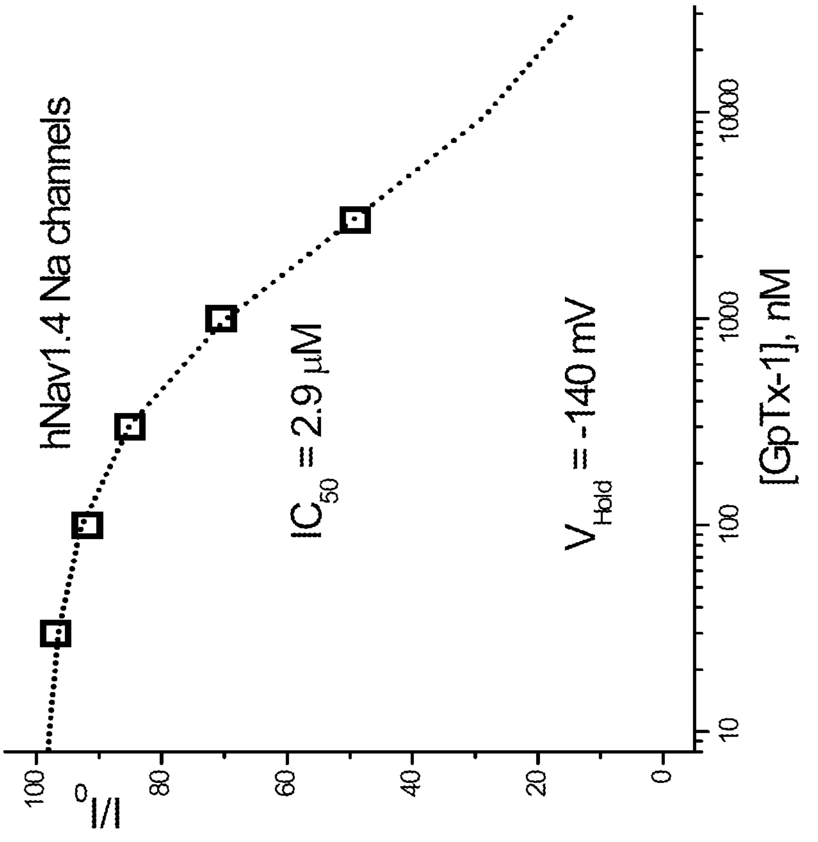

FIG. 27 shows a dose-response curve of GpTx-1 (SEQ ID NO:1) against hNav1.4 channels. Peak inward hNav1.4 currents were measured at −10 mV in the presence of increasing concentrations of GpTx-1; cells were held at −140 mV. Currents were normalized with 100 representing Nav1.4 current with no peptide addition and 0 representing Nav1.4 current following complete block. The $IC_{50}$ of GpTx-1 against hNav1.4 channels was 2.9 μM.

Figure 28:
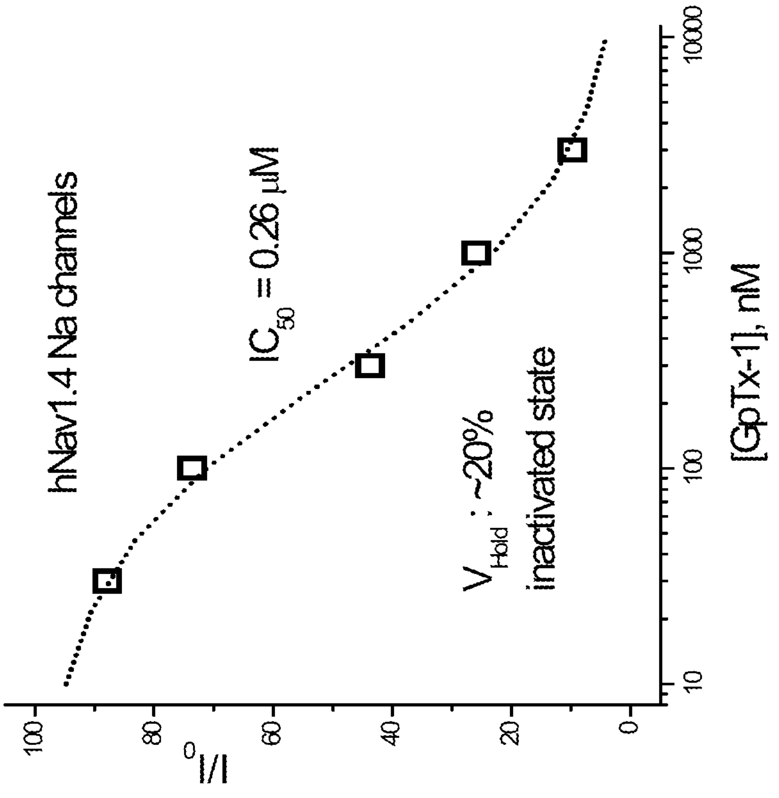

FIG. 28 shows a dose-response curve of GpTx-1 (SEQ ID NO:1) against hNav1.4 channels. Peak inward hNav1.4 currents were measured at −10 mV in the presence of increasing concentrations of GpTx-1; cells were held at a potential yielding approximately 20% inactivation. Note that GpTx-1 is more potent against hNav1.4 when channels are partially inactivated. Currents were normalized with 100 representing Nav1.4 current with no peptide addition and 0 representing Nav1.4 current following complete block. The $IC_{50}$ of GpTx-1 against partially inactivated hNav1.4 channels was 0.26 μM.

Figure 29:
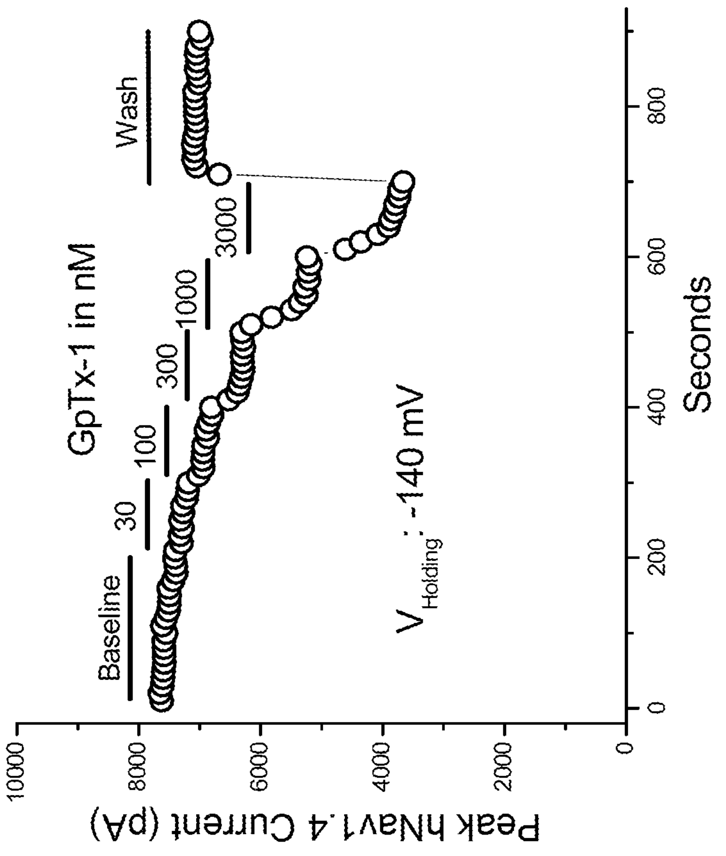

FIG. 29 shows a time course of increasing concentrations of GpTx-1 (SEQ ID NO:1) against hNav1.4 channels. Peak inward hNav1.4 currents were measured at −10 mV every 10 seconds in the presence of increasing concentrations of GpTx-1; cells were held at a −140 mV. "Baseline" indicates hNav1.4 current in the absence of GpTx-1 and "Wash" indicates hNav1.4 current following removal of GpTx-1.

Figure 30:
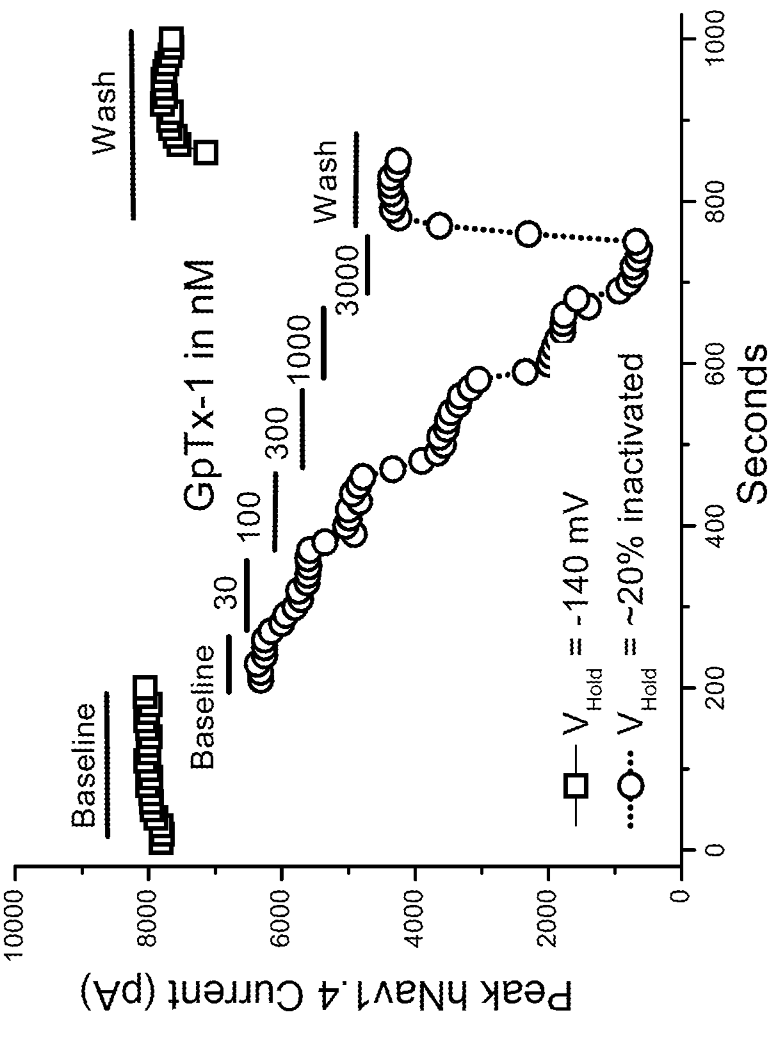

FIG. 30 shows a time course of increasing concentrations of GpTx-1 (SEQ ID NO:1) against hNav1.4 channels. Peak inward hNav1.4 currents were measured at −10 mV every 10 seconds in the presence of increasing concentrations of GpTx-1; cells were held at −140 mV (squares) or a potential yielding approximately 20% inactivation (circles). "Baseline" indicates hNav1.4 current in the absence of GpTx-1 and "Wash" indicates hNav1.4 current following removal of GpTx-1. Note that GpTx-1 is more potent against hNav1.4 when channels are partially inactivated.

Figure 31:
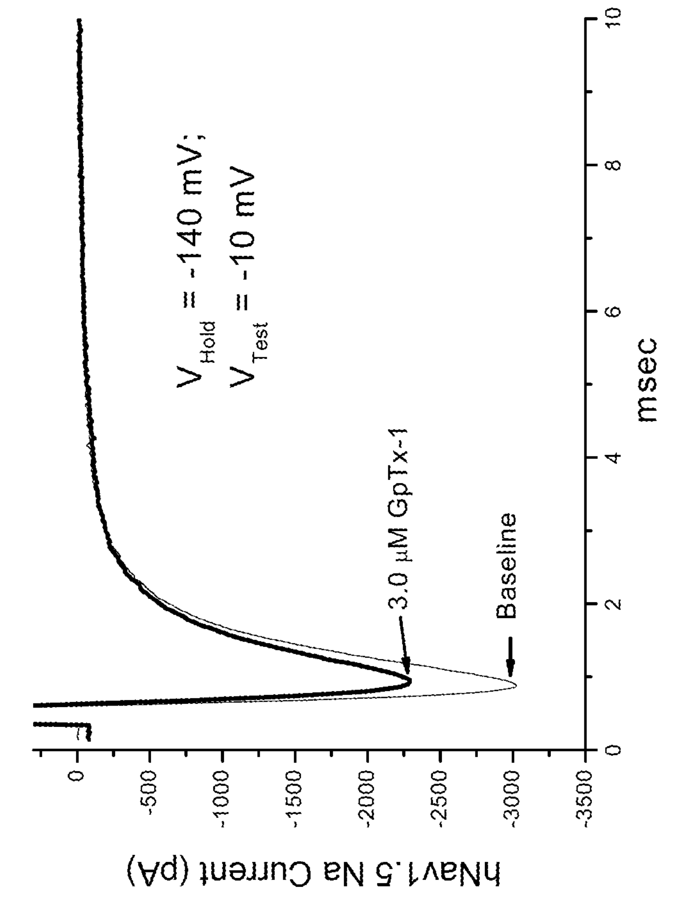

FIG. 31 shows the effect of GpTx-1 (SEQ ID NO:1) on hNav1.5 channels. Cells were held at −140 mV and peak inward hNav1.5 currents were measured at −10 mV. "Baseline" trace shows hNav1.5 current before GpTx-1, and '3 μM GpTx-1' trace shows hNav1.5 current after GpTx-1 addition.

Figure 32:
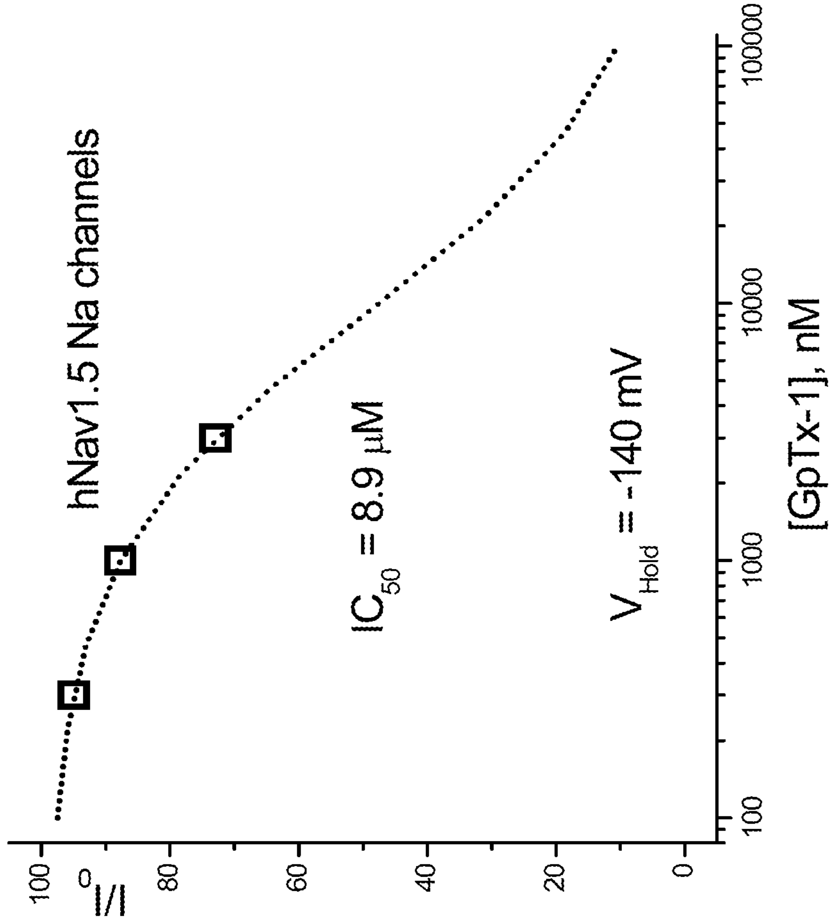

FIG. 32 shows a dose-response curve of GpTx-1 (SEQ ID NO:1) against hNav1.5 channels. Peak inward hNav1.5 currents were measured at −10 mV in the presence of increasing concentrations of GpTx-1; cells were held at −140 mV. Currents were normalized with 100 representing Nav1.5 current with no peptide addition and 0 representing Nav1.5 current following complete block. The $IC_{50}$ of GpTx-1 against hNav1.5 channels was 8.9 μM.

Figure 33:
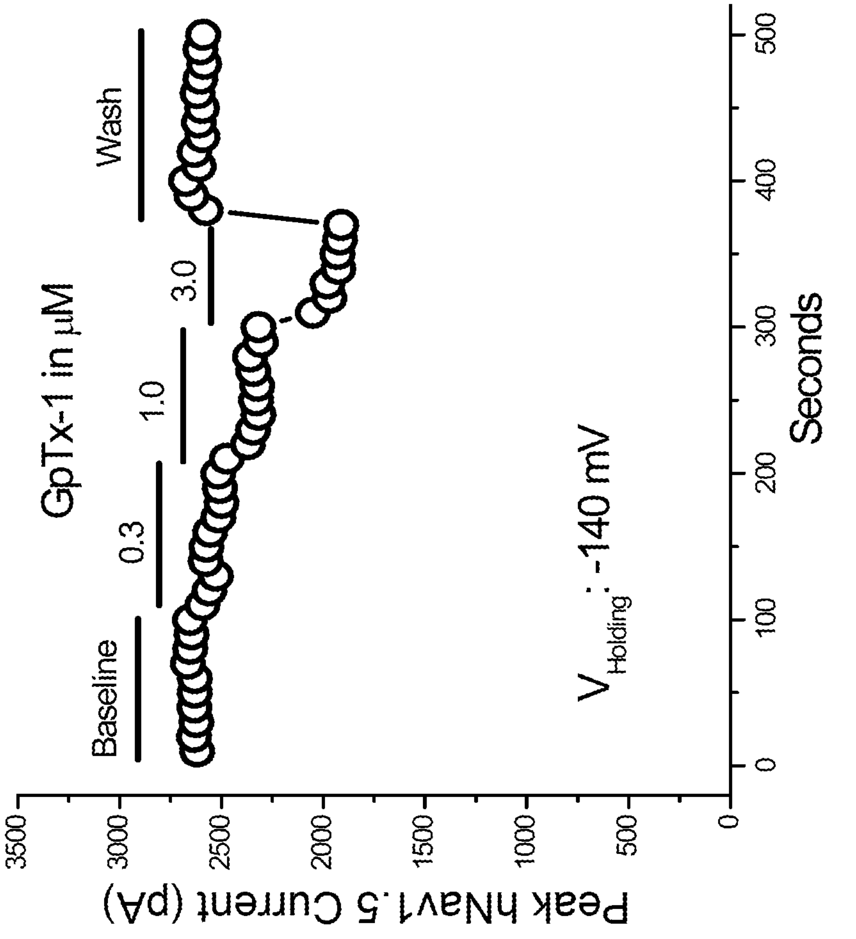

FIG. 33 shows a time course of increasing concentrations of GpTx-1 (SEQ ID NO:1) against hNav1.5 channels. Peak inward hNav1.5 currents were measured at −10 mV every 10 seconds in the presence of increasing concentrations of GpTx-1; cells were held at a −140 mV. "Baseline" indicates hNav1.5 current in the absence of GpTx-1 and "Wash" indicates hNav1.5 current following removal of GpTx-1.

Figure 34:
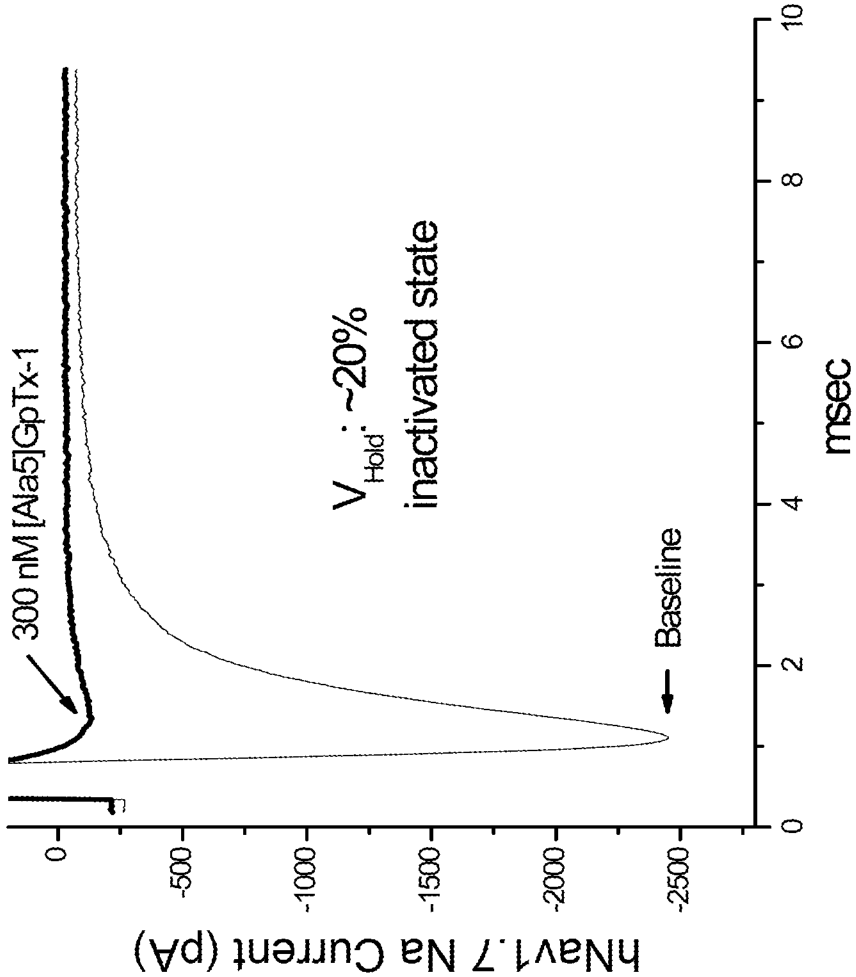

FIG. 34 shows the effect of [Ala5]GpTx-1 (SEQ ID NO:22) on hNav1.7 channels. Cells were held at −140 mV and peak inward hNav1.7 currents were measured at −10 mV. "Baseline" trace shows hNav1.7 current before [Ala5]GpTx-1 addition, and "300 nM [Ala5]GpTx-1" trace shows hNav1.7 current after [Ala5]GpTx-1 addition. Cells were held at a potential yielding approximately 20% inactivation.

Figure 35:
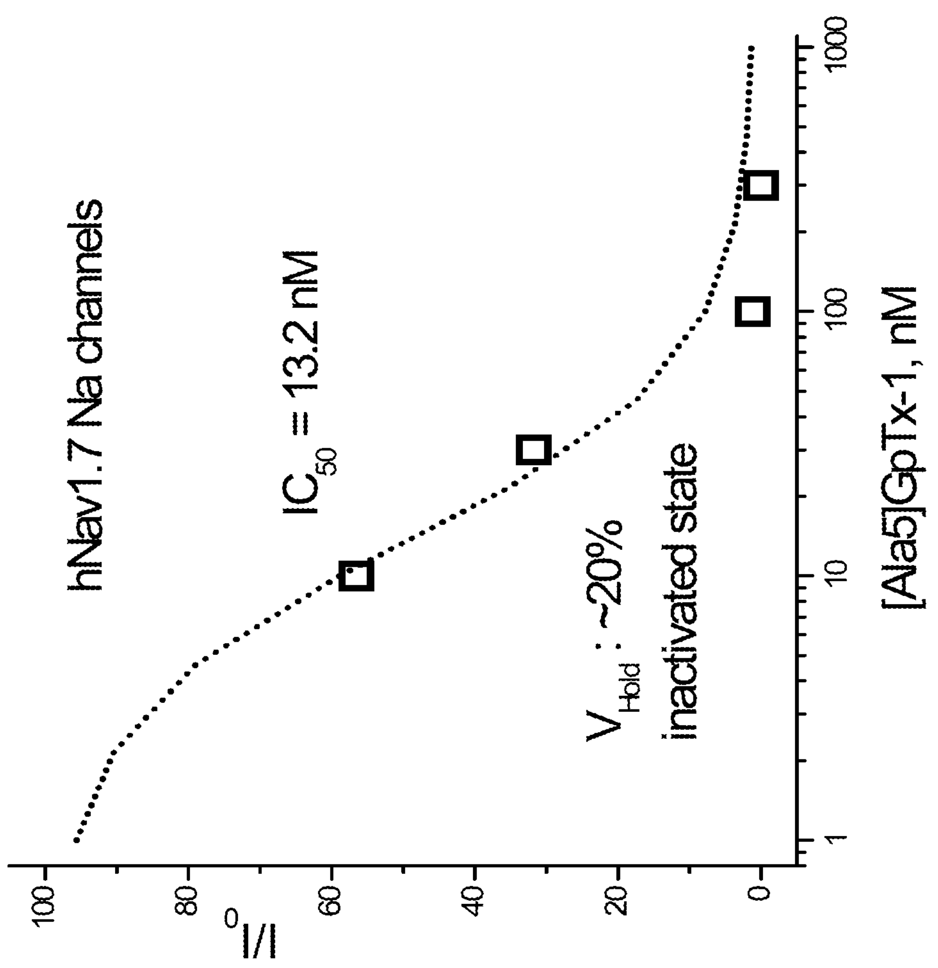

FIG. 35 shows a dose-response curve of [Ala5]GpTx-1 (SEQ ID NO:22) against hNav1.7 channels. Peak inward hNav1.7 currents were measured at −10 mV in the presence of increasing concentrations of [Ala5]GpTx-1; cells were held at a potential yielding approximately 20% inactivation. Currents were normalized with 100 representing Nav1.7 current with no peptide addition and 0 representing Nav1.7 current following complete block. The $IC_{50}$ of [Ala5]GpTx-1 against partially inactivated hNav1.7 channels was 13.2 nM.

Figure 36:
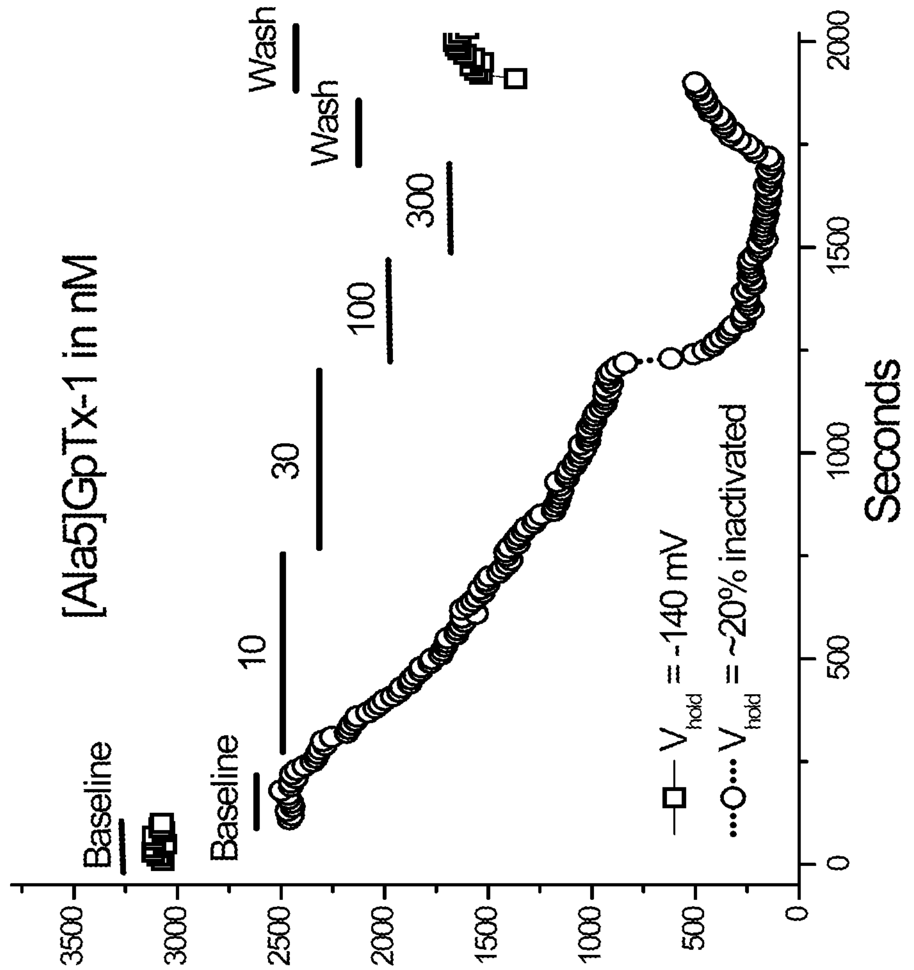

FIG. 36 shows a time course of increasing concentrations of [Ala5]GpTx-1 (SEQ ID NO:22) against hNav1.7 channels. Peak inward hNav1.7 currents were measured at −10 mV every 10 seconds in the presence of increasing concentrations of [Ala5]GpTx-1; cells were held at −140 mV (squares) or a potential yielding approximately 20% inactivation (circles). "Baseline" indicates hNav1.7 current in the absence of [Ala5]GpTx-1 and "Wash" indicates hNav1.7 current following removal of [Ala5]GpTx-1.

Figure 37:
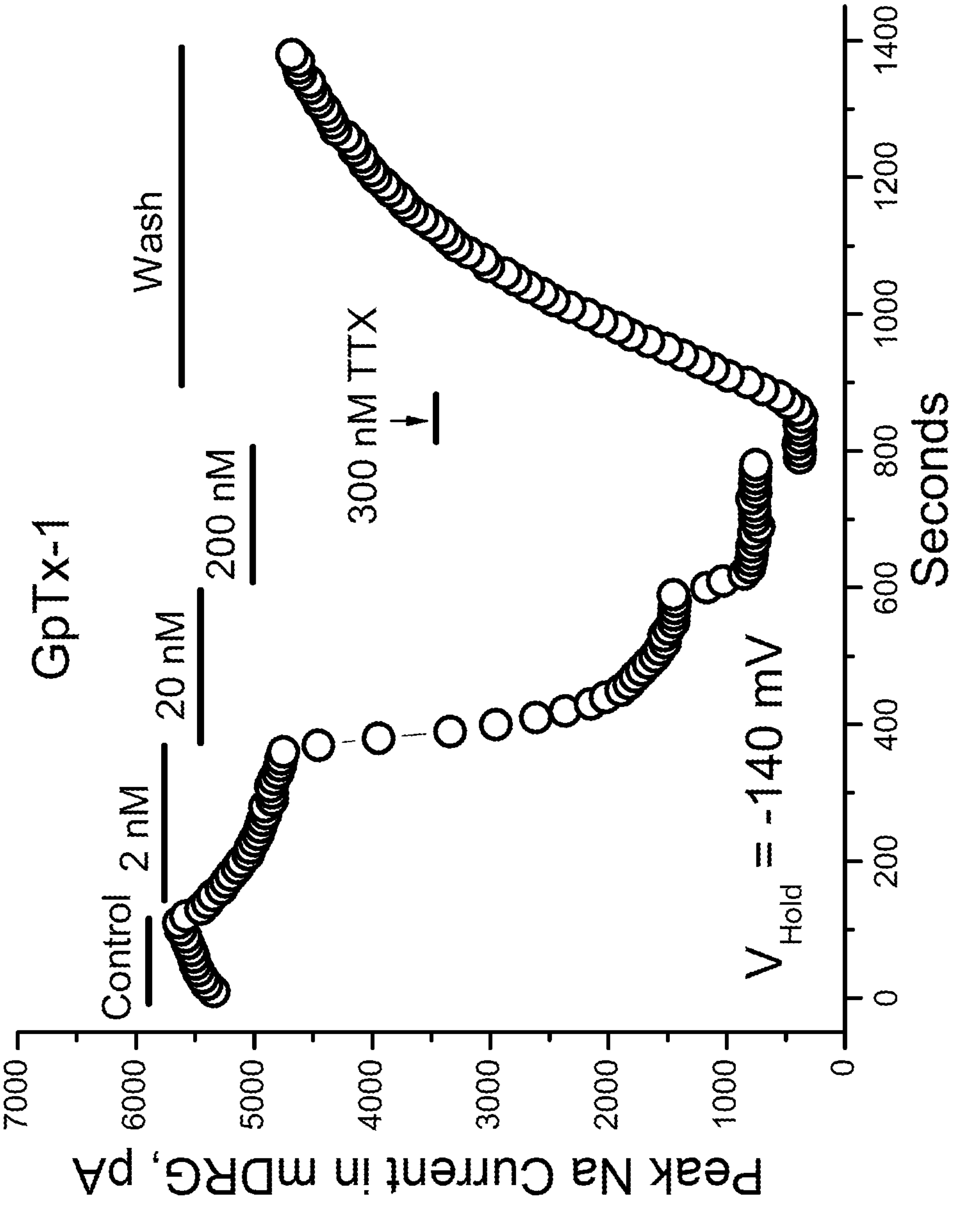

FIG. 37 shows a time course of increasing concentrations of GpTx-1 (SEQ ID NO:1) against TTX-sensitive Nav channels in mouse dorsal root ganglion (DRG) neurons. Peak inward Nay currents were measured at −10 mV every 10 seconds in the presence of increasing concentrations of GpTx-1; cells were held at −140 mV. "Control" indicates Nav current in the absence of GpTx-1, 'TTX' indicates Nav current in the presence of 300 nM TTX, and "Wash" indicates Nav current following removal of GpTx-1 and TTX. Note that GpTx-1 blocked nearly all TTX-sensitive Nav current. Currents measured in this study were almost all TTX-sensitive currents, identified at the start of the record on the basis of fast kinetics of inactivation.

Figure 38:
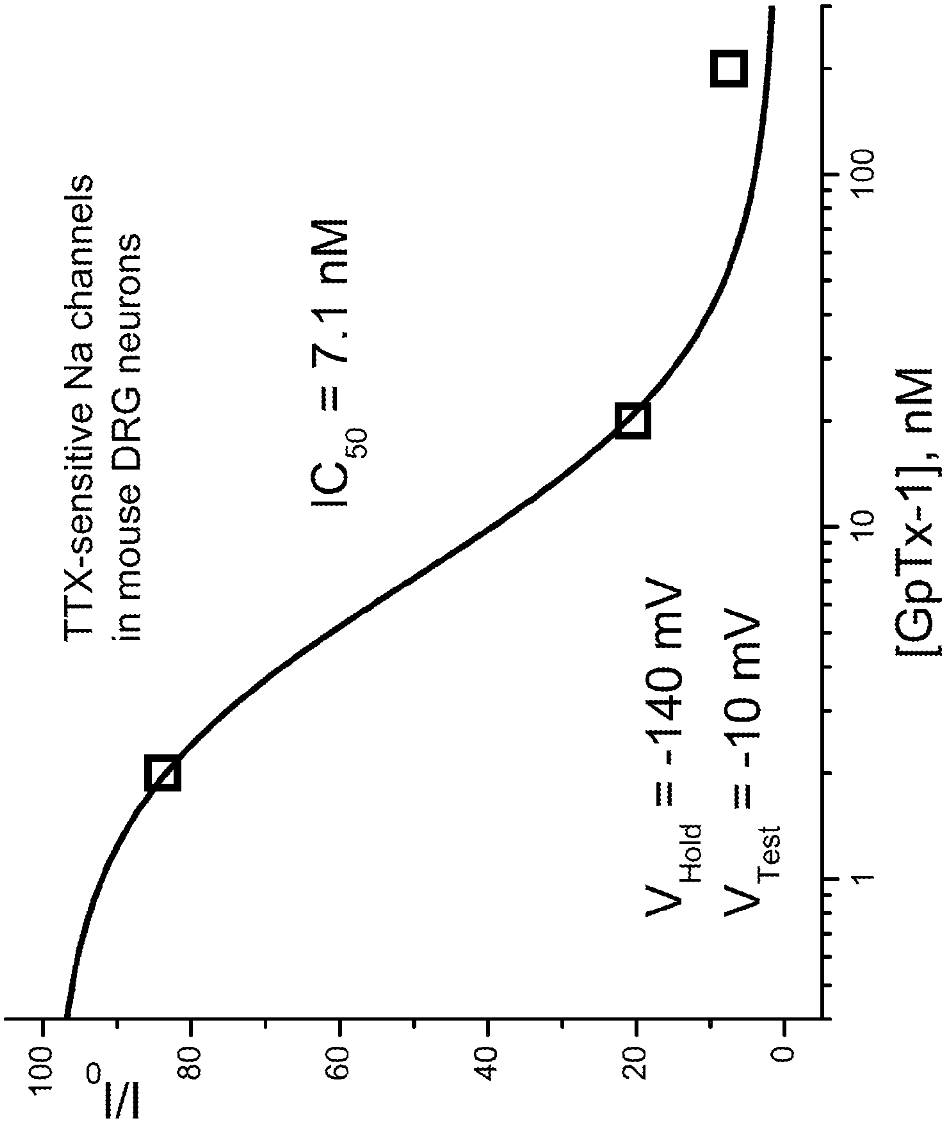

FIG. 38 shows a representative dose-response curve of GpTx-1 (SEQ ID NO:1) against TTX-sensitive Nav channels in mouse DRG neurons. Peak inward Nav currents were measured at −10 mV in the presence of increasing concentrations of GpTx-1; cells were held at −140 mV. The $IC_{50}$ value of GpTx-1 against TTX-sensitive sodium channels in mDRG neurons was measured to be 7.1 nM. Currents were normalized with 100 representing TTX-sensitive current with no peptide addition and 0 representing TTX-sensitive current following complete block.

Figure 39:
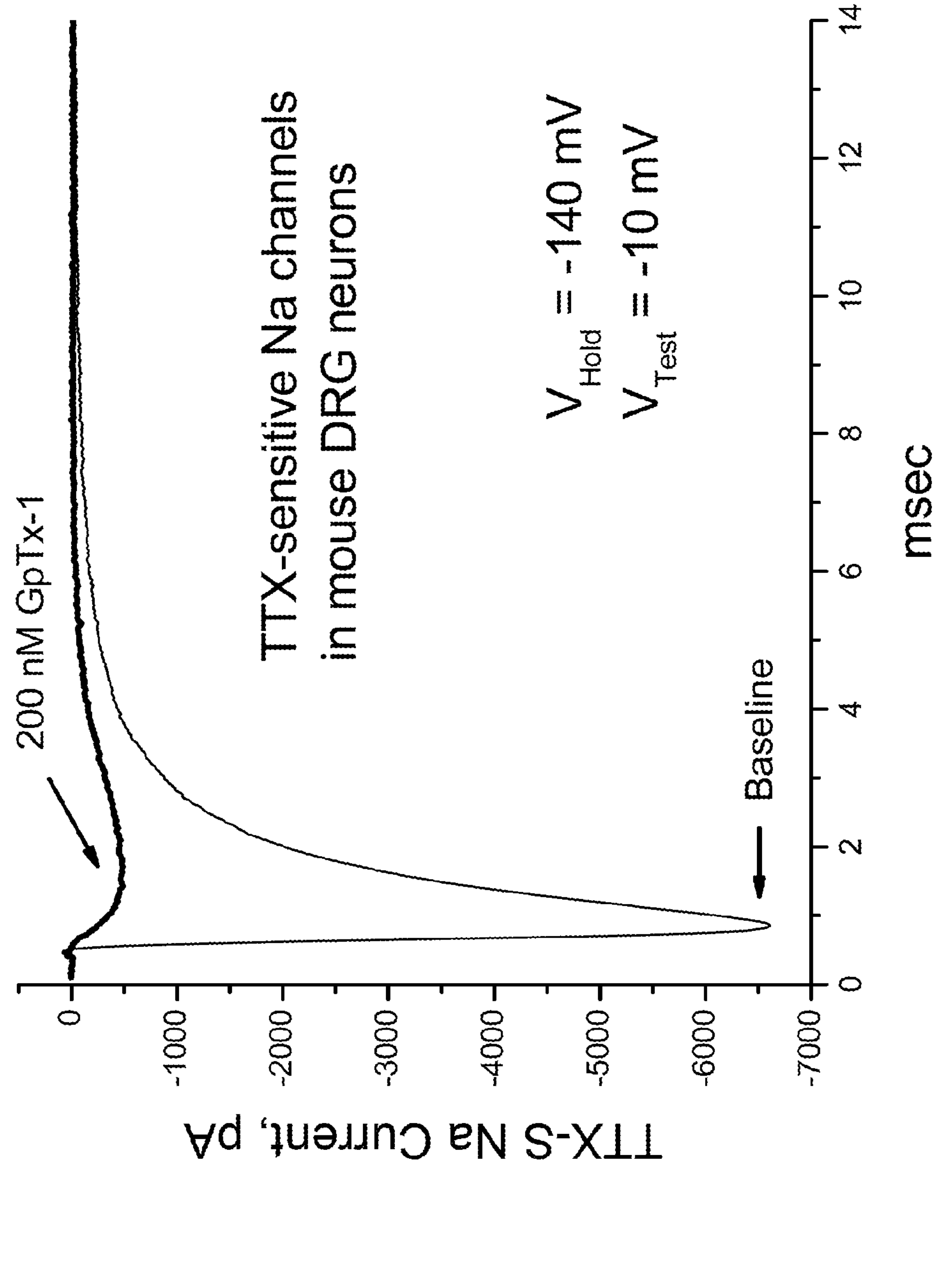

FIG. 39 shows the effect of a single concentration of GpTx-1 (SEQ ID NO:1) on TTX-sensitive Nav channels in mouse DRG neurons. Cells were held at −140 mV and peak inward Nav currents were measured at −10 mV. "Baseline" trace shows Nav current before GpTx-1 addition, and "200 nM GpTx-1" trace shows Nay current after GpTx-1 addition. Note that inactivation of control currents was complete in a couple milliseconds, which distinguishes TTX-sensitive current from TTX-resistant current.

Figure 40:
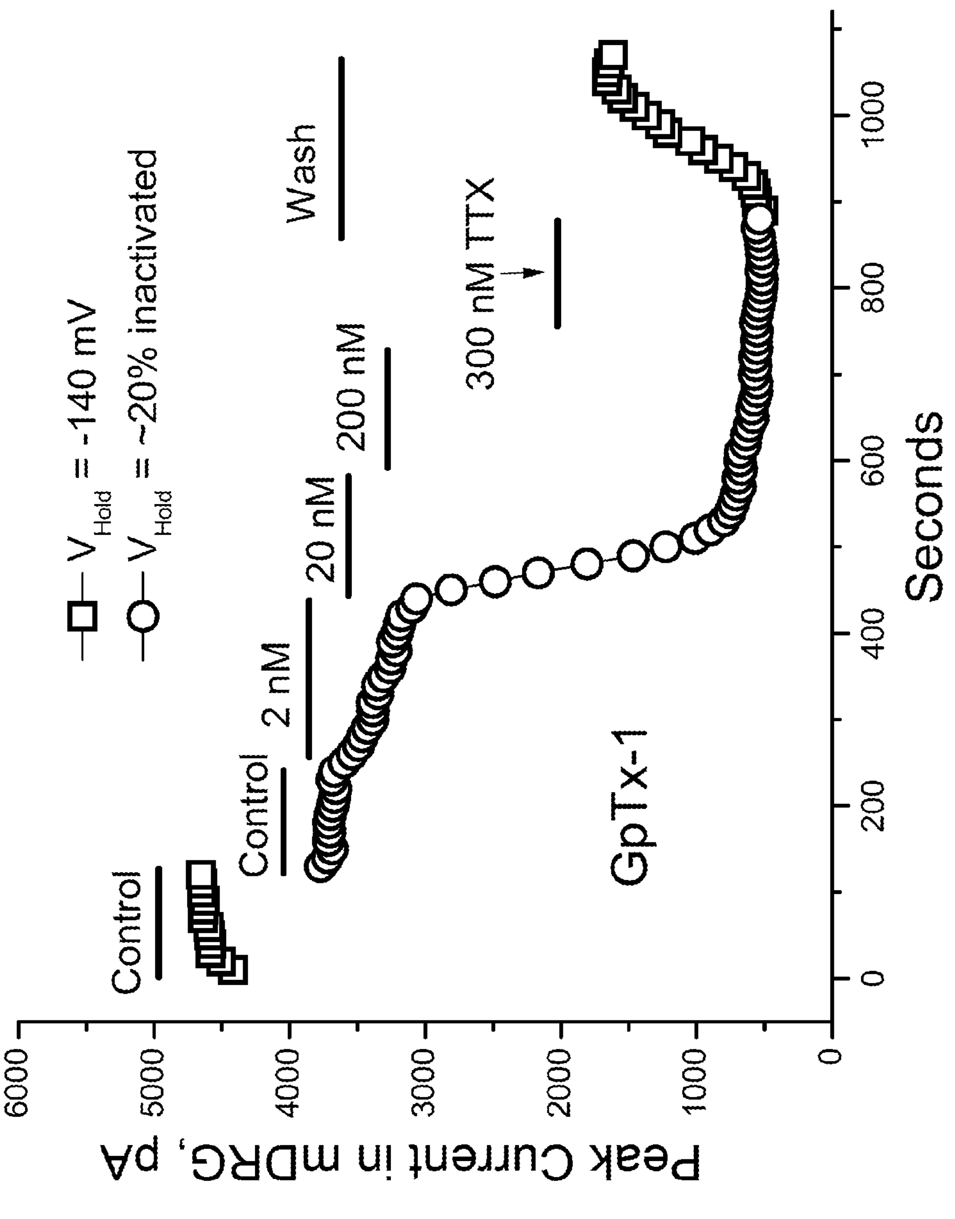

FIG. 40 shows the time course of increasing concentrations of GpTx-1 (SEQ ID NO:1) against TTX-sensitive Nav channels in mouse DRG neurons. Peak inward Nav currents were measured at −10 mV every 10 seconds in the presence of increasing concentrations of GpTx-1; cells were held at a potential yielding approximately 20% inactivation. "Control" indicates Nay current in the absence of GpTx-1, "TTX" indicates Nav current in the presence of 300 nM TTX, and "Wash" indicates Nay current following removal of GpTx-1 and TTX. Note that GpTx-1 blocked all TTX-sensitive Nav current, since 300 nM TTX gave no additional current block.

Figure 41:
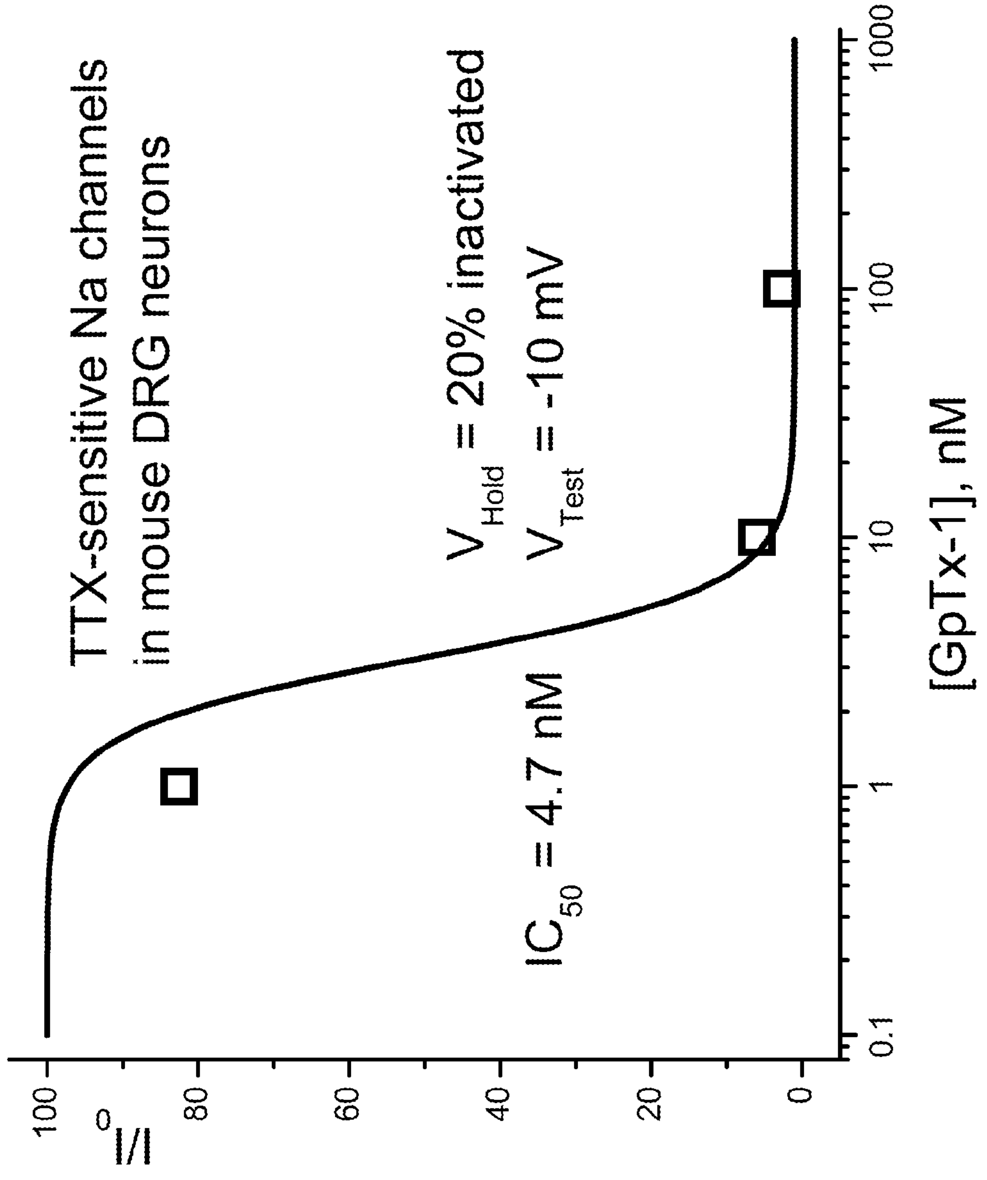

FIG. 41 shows a representative dose-response curve of GpTx-1 (SEQ ID NO:1) against TTX-sensitive Nav channels in mouse DRG neurons, as defined by fast inactivation kinetics. Peak inward Nay currents were measured at −10 mV in the presence of increasing concentrations of GpTx-1; cells were held at a potential yielding approximately 20% inactivation. The $IC_{50}$ value of GpTx-1 against TTX-sensitive sodium channels in mDRG neurons was measured to be 4.7 nM. Currents were normalized with 100 representing TTX-sensitive current with no peptide addition and 0 representing TTX-sensitive current following complete block.

Figure 42:
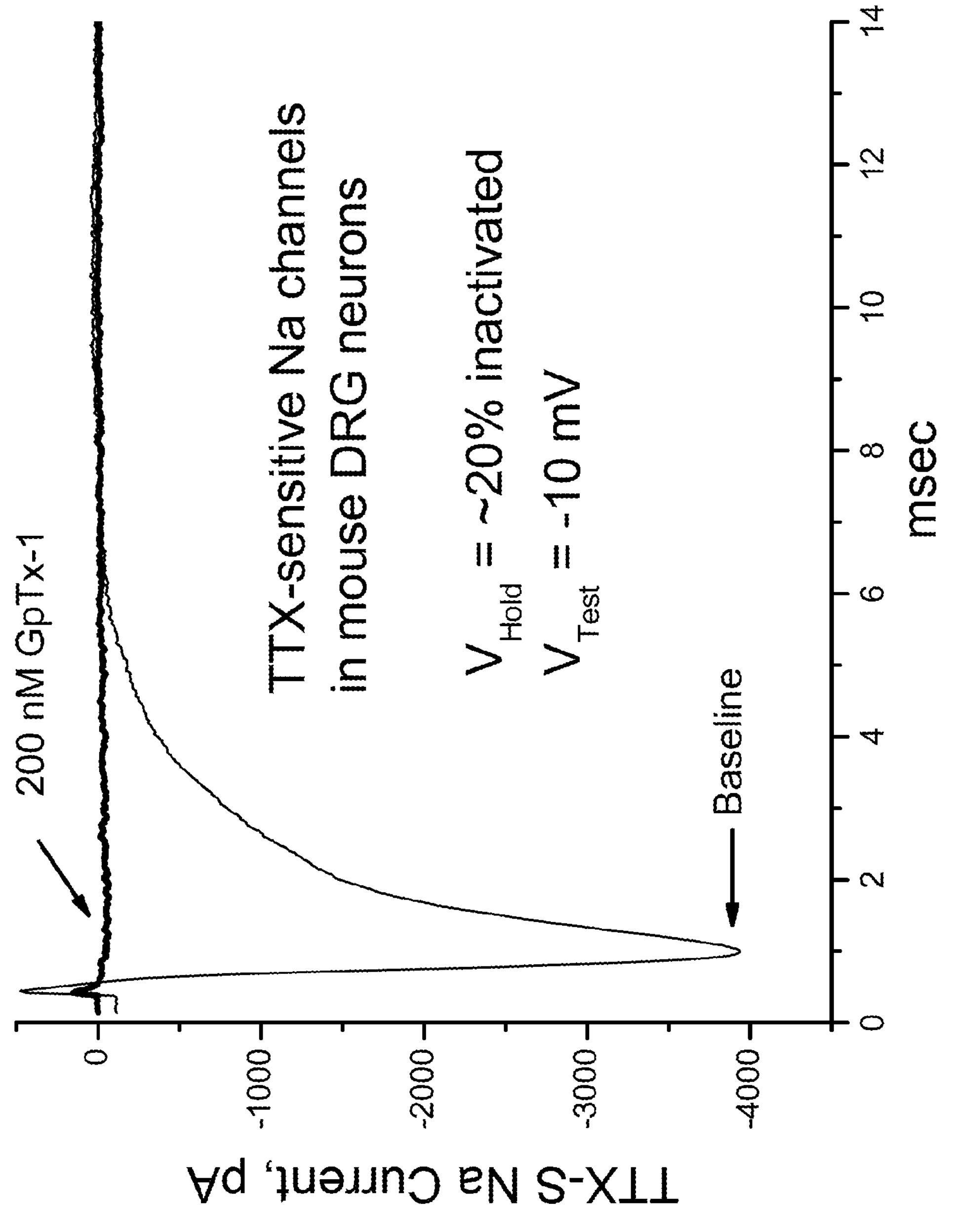

FIG. 42 shows the effect of GpTx-1 (SEQ ID NO:1) on TTX-sensitive Nav channels in mouse DRG neurons. Cells were held at a potential yielding approximately 20% inactivation and peak inward Nav currents were measured at −10 mV. "Baseline" trace shows Nav current before GpTx-1 addition, and "200 nM GpTx-1" trace shows Nav current after GpTx-1 addition.

Figure 43:
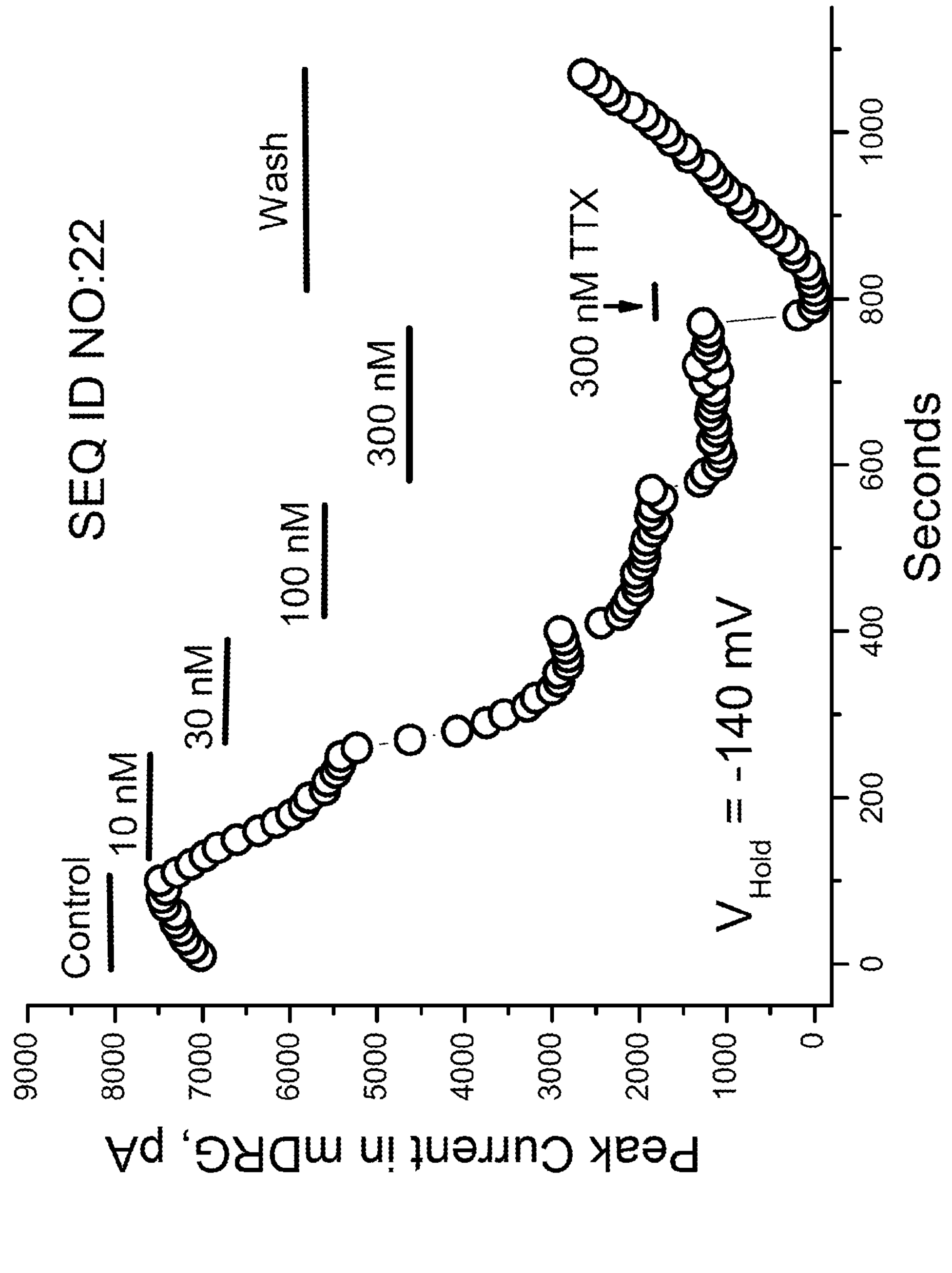

FIG. 43 shows the time course of increasing concentrations of [Ala5]GpTx-1(1-34) (SEQ ID NO:22) against TTX-sensitive Nav channels in mouse DRG neurons. Peak inward Nav currents were measured at −10 mV every 10 seconds in the presence of increasing concentrations of [Ala5]GpTx-1(1-34) (SEQ ID NO:22); cells were held at −140 mV. "Control" indicates Nav current in the absence of [Ala5]GpTx-1(1-34) (SEQ ID NO:22), "TTX'" indicates Nav current in the presence of 300 nM TTX, and "Wash" indicates Nay current following removal of [Ala5]GpTx-1(1-34) (SEQ ID NO:22) and TTX. Note that [Ala5]GpTx-1(1-34) (SEQ ID NO:22) blocked nearly all TTX-sensitive Nav current.

Figure 44:
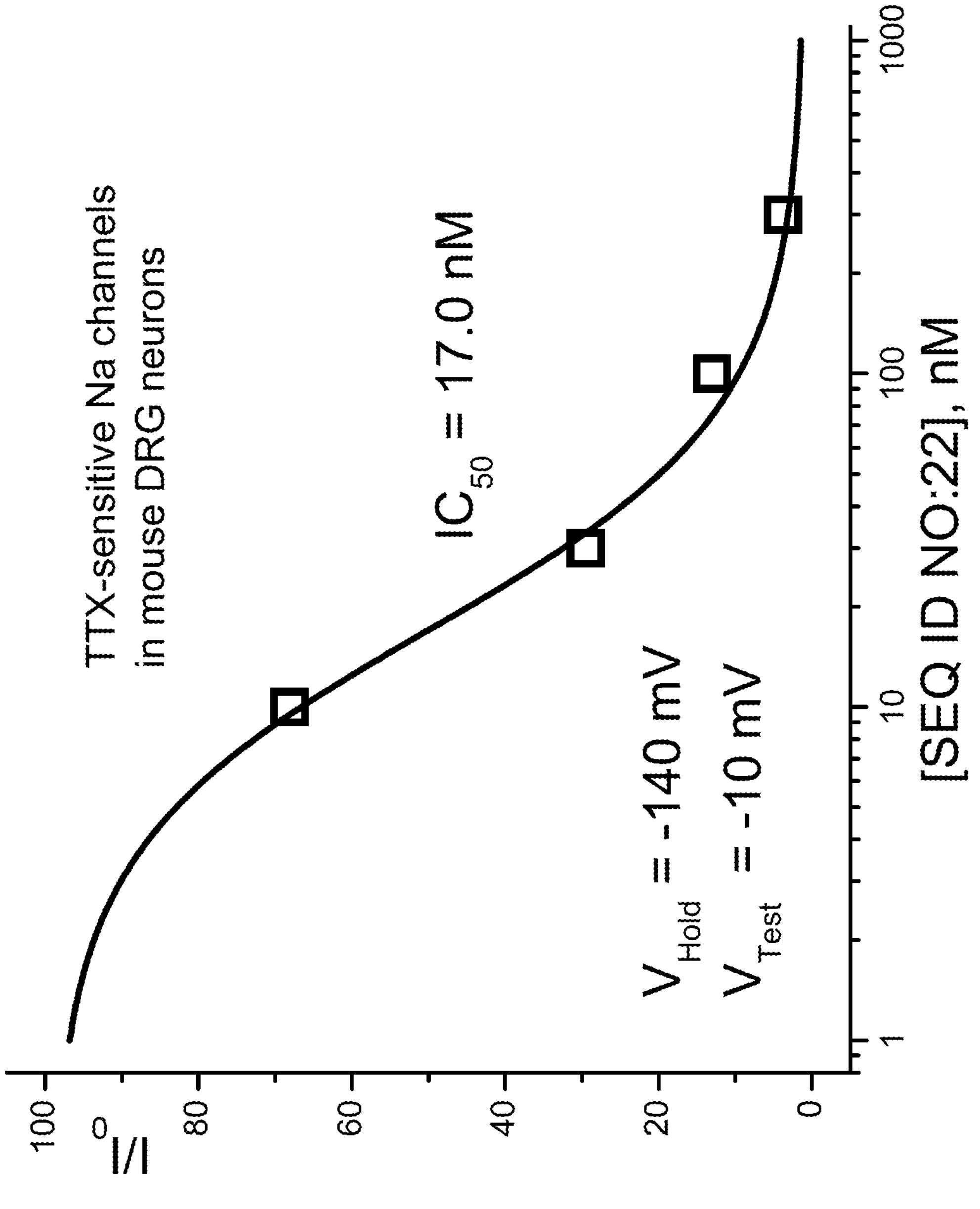

FIG. 44 shows a representative dose-response curve of [Ala5]GpTx-1(1-34) (SEQ ID NO:22) against TTX-sensitive Nav channels in mouse DRG neurons. Peak inward Nav currents were measured at −10 mV in the presence of increasing concentrations of [Ala5]GpTx-1(1-34); cells were held at −140 mV. The $IC_{50}$ value of [Ala5]GpTx-1(1-34) against TTX-sensitive sodium channels in mDRG neurons was measured to be 17.0 nM. Currents were normalized with 100 representing TTX-sensitive current with no peptide addition and 0 representing TTX-sensitive current following complete block.

Figure 45:
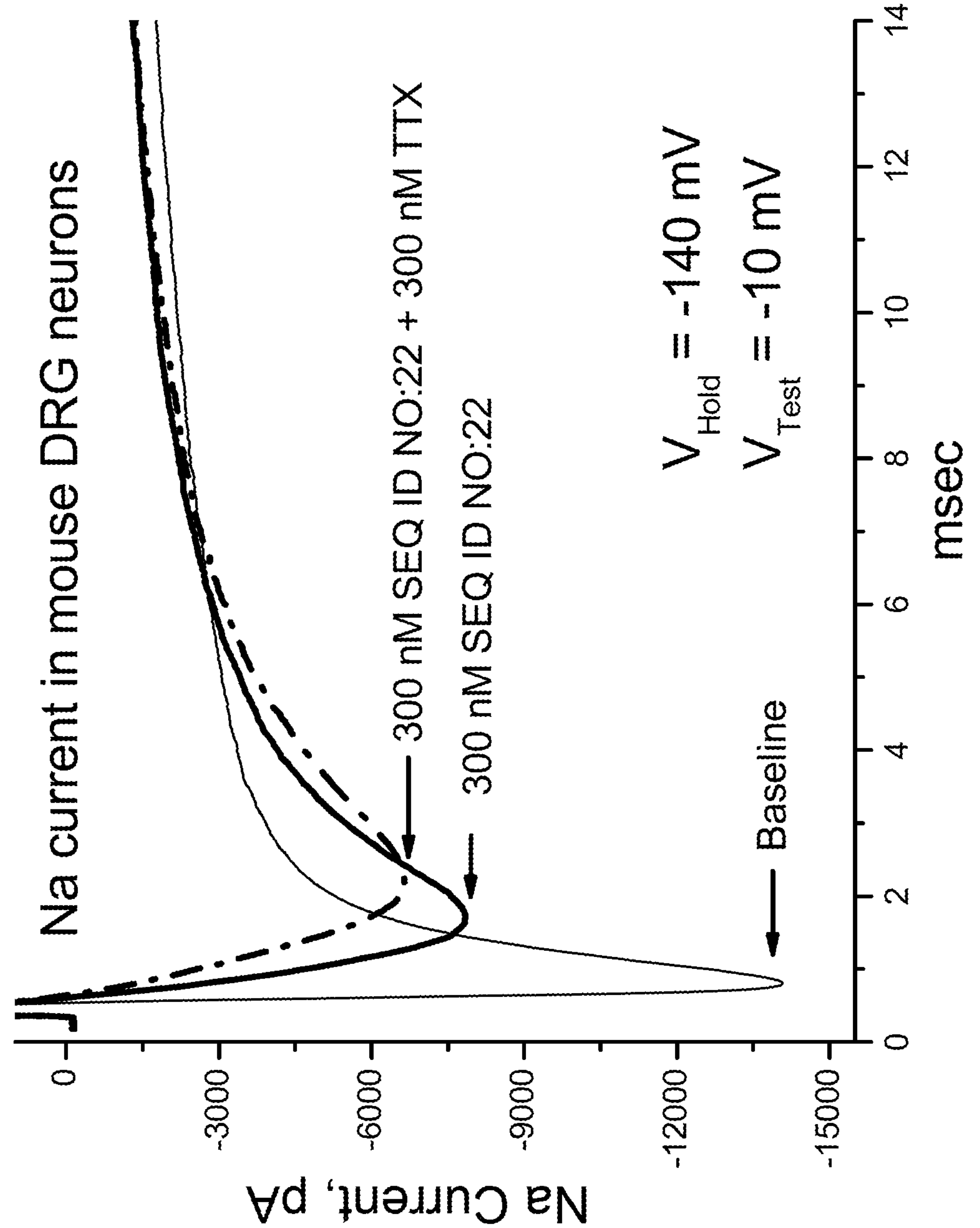

FIG. 45 shows the effect of [Ala5]GpTx-1(1-34) (SEQ ID NO:22) on TTX-sensitive Nay channels in mouse DRG neurons. Cells were held at −140 mV and peak inward Nay currents were measured at −10 mV. "Baseline" trace shows Nay current before addition of [Ala5]GpTx-1(1-34) (SEQ ID NO:22), "300 nM SEQ ID NO:22" trace shows Nav current after SEQ ID NO:22 addition, and "300 nM SEQ ID NO:22+ 300 nM TTX" trace shows Nav current after SEQ ID NO:22 and TTX addition. Note that [Ala5]GpTx-1(1-34) selectively blocked TTX-sensitive Nay current but not TTX-resistant Nav current.

Figure 46:
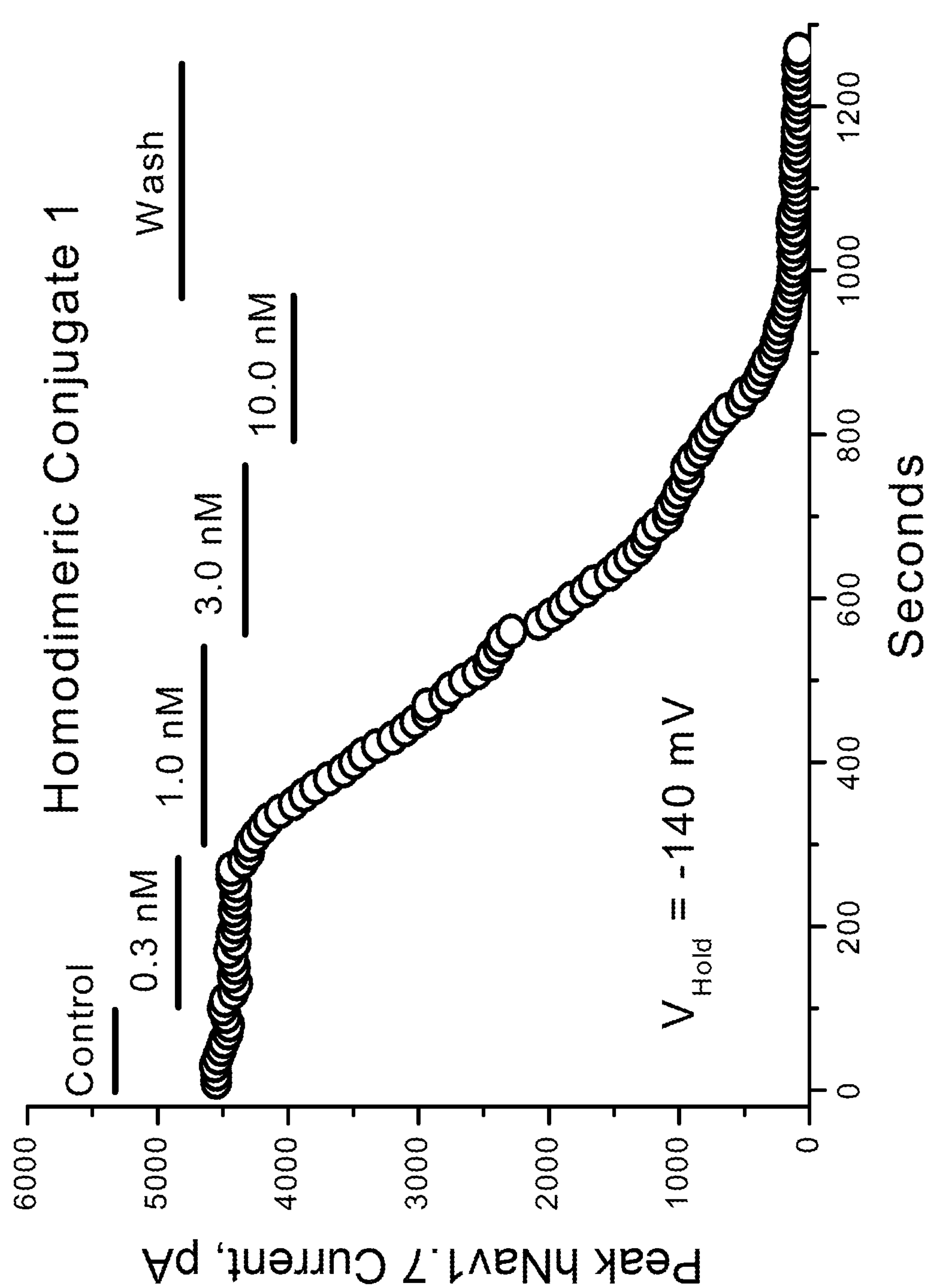

FIG. 46 shows a time course of increasing concentrations of a homodimeric conjugate (Homodimeric Conjugate 1) of peptide monomer [Phe6,Atz13]GpTx-1(1-34) (SEQ ID NO:591) against hNav1.7 channels. Peak inward hNav1.7 currents were measured at −10 mV every 10 seconds in the presence of increasing concentrations of Homodimeric Conjugate 1; cells were held at −140 mV. “Control” indicates human Nav1.7 (hNav1.7) current in the absence of Homodimeric Conjugate 1 and “Wash” indicates hNav1.7 current following removal of Homodimeric Conjugate 1.

Figure 47:
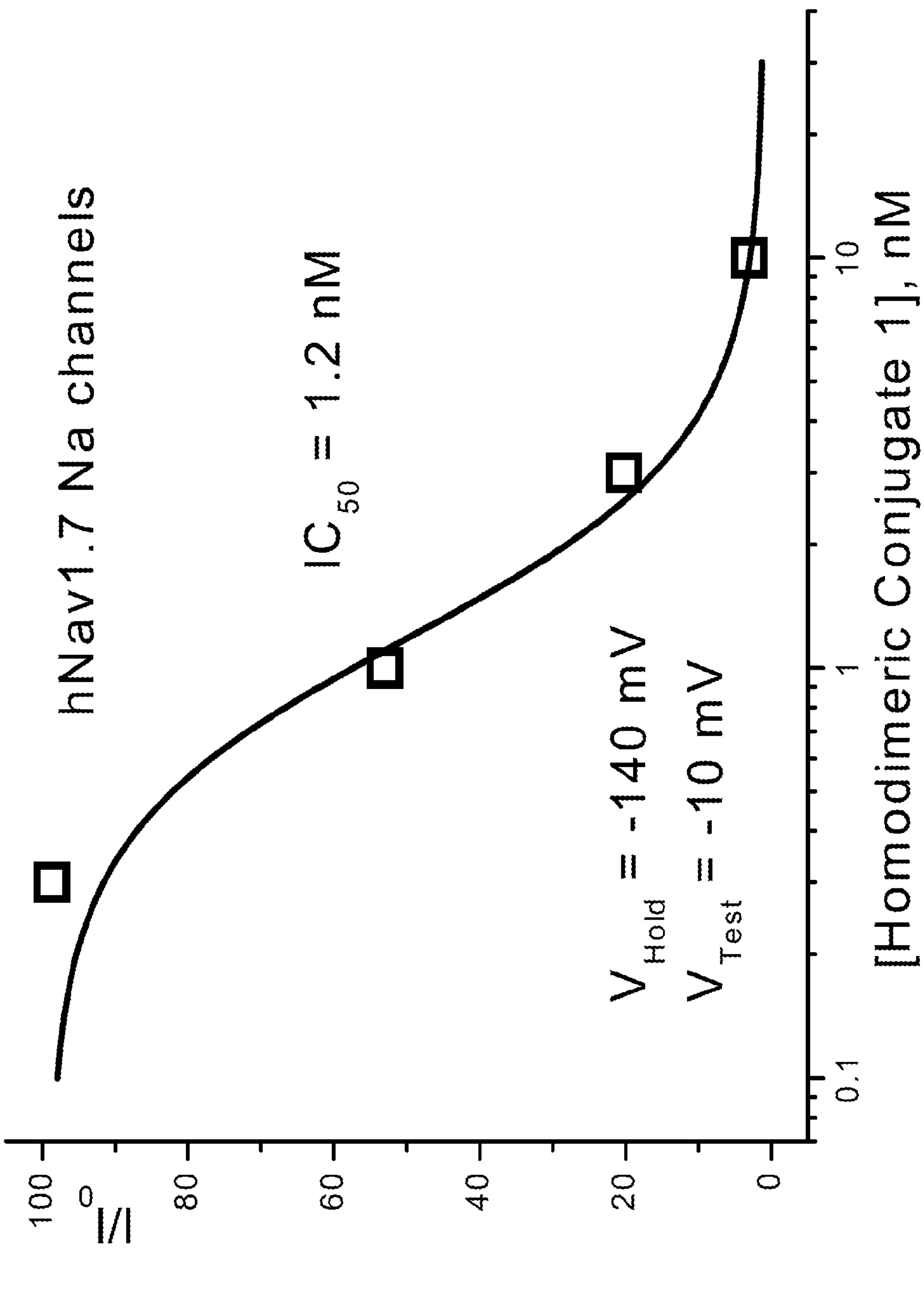

FIG. 47 shows a representative dose-response curve of Homodimeric Conjugate 1 against human Nav1.7 channels. Peak inward hNav1.7 currents were measured at −10 mV in the presence of increasing concentrations of Homodimeric Conjugate 1; cells were held at −140 mV. The $IC_{50}$ value of Homodimeric Conjugate 1 against hNav1.7 sodium channels was measured to be 1.2 nM. Currents were normalized with 100 representing Nav1.7 current with no peptide addition and 0 representing Nav1.7 current following complete block.

Figure 48:
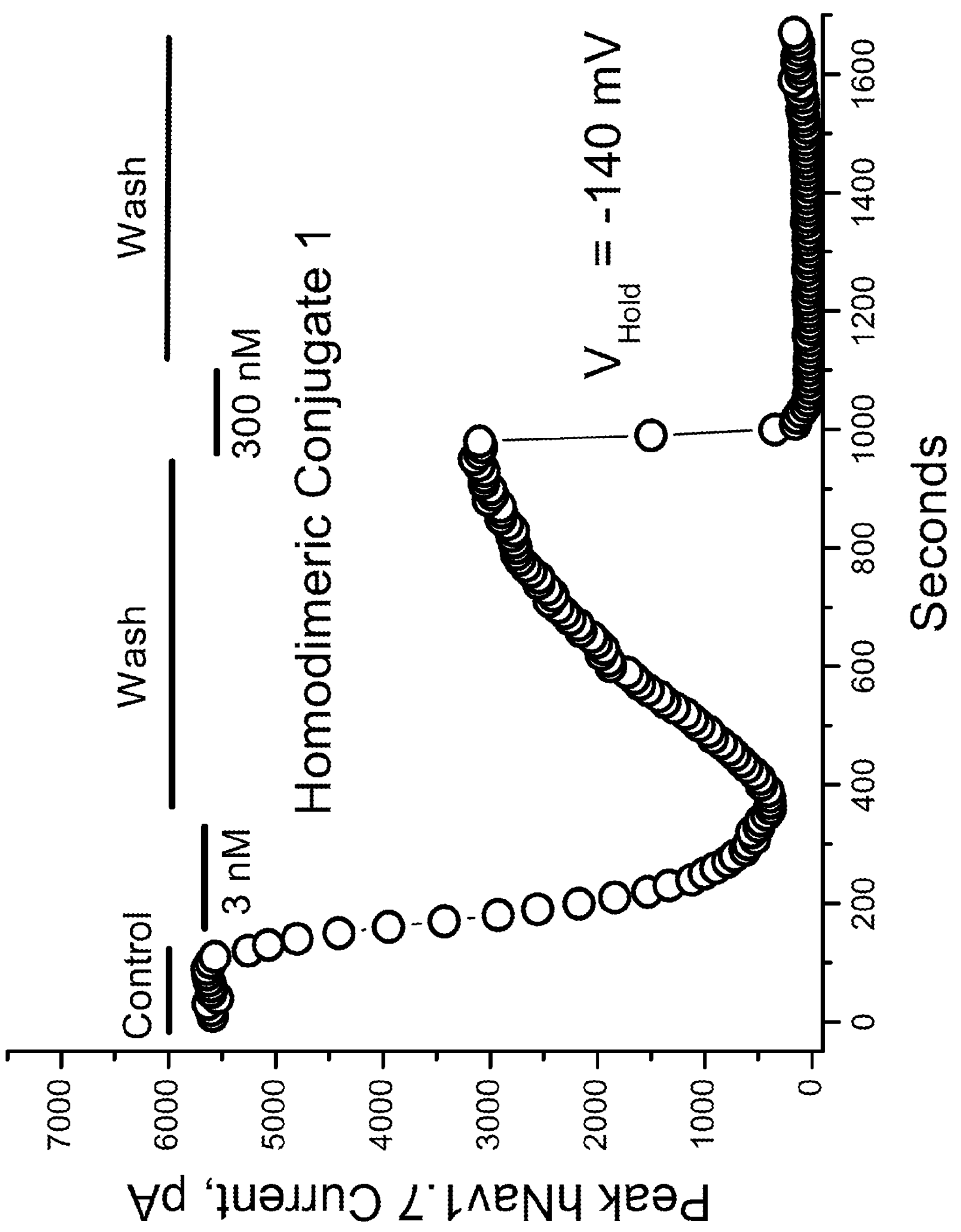

FIG. 48 shows the recovery of hNav1.7 currents following washout of Homodimeric Conjugate 1. Peak inward hNav1.7 currents were measured at −10 mV every 10 seconds in the presence of 3 nM or 300 nM Homodimeric Conjugate 1; cells were held at a −140 mV. “Control” indicates hNav1.7 current in the absence of Homodimeric Conjugate 1 and “Wash” indicates hNav1.7 current following removal of Homodimeric Conjugate 1. Note that hNav1.7 currents partially recover following washout of 3 nM Homodimeric Conjugate 1 but do not recover following washout of 300 nM of Homodimeric Conjugate 1.

Figure 49:
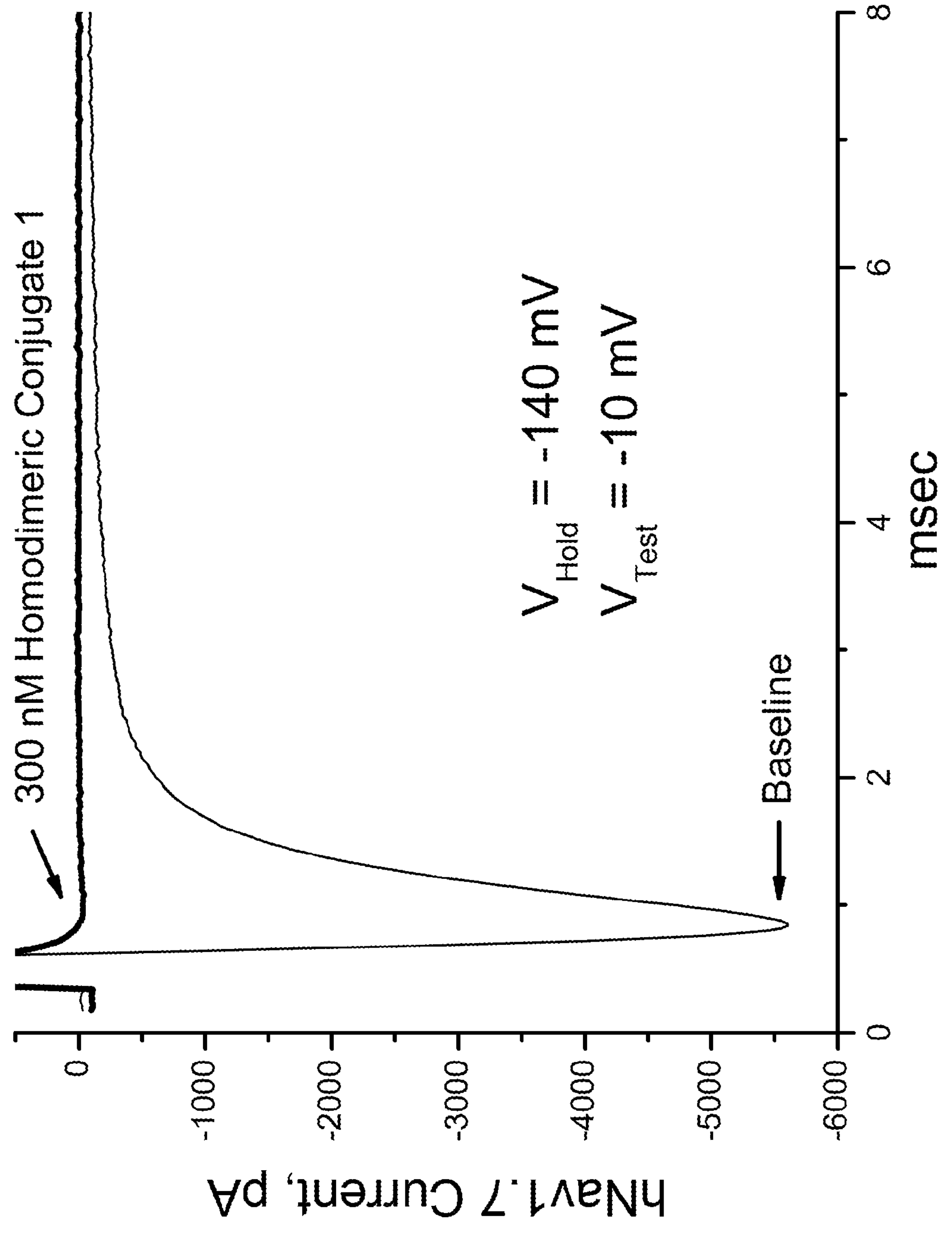

FIG. 49 shows the effect of Homodimeric Conjugate 1 on hNav1.7 channels. Cells were held at −140 mV and peak inward hNav1.7 currents were measured at −10 mV. “Baseline” trace shows hNav1.7 current before Homodimeric Conjugate 1 addition, and ‘10 nM Homodimeric Conjugate 1’ trace shows hNav1.7 current after Homodimeric Conjugate 1 addition.

Figure 50:
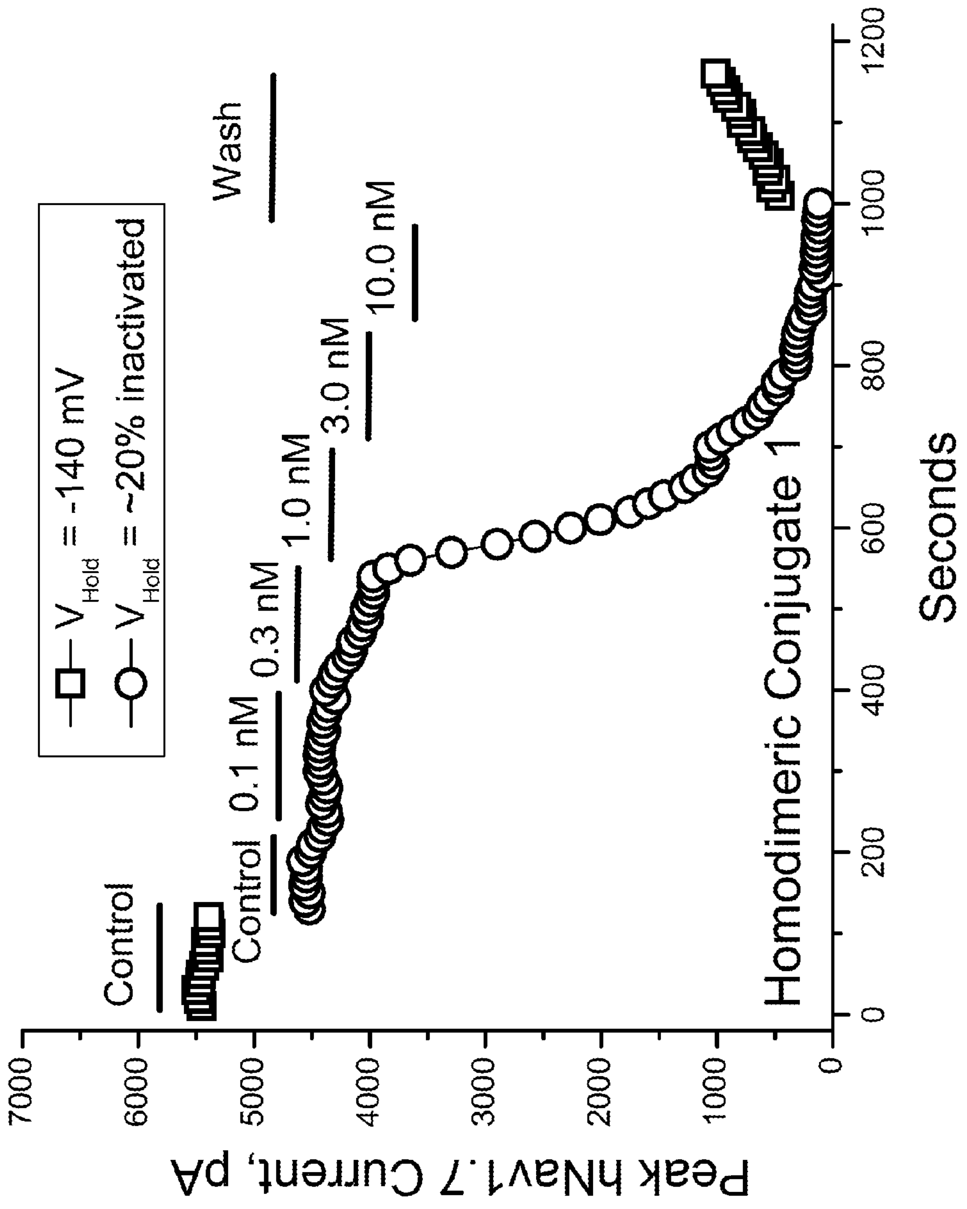

FIG. 50 shows a time course of increasing concentrations of Homodimeric Conjugate 1 against hNav1.7 channels. Peak inward hNav1.7 currents were measured at −10 mV every 10 seconds in the presence of increasing concentrations of Homodimeric Conjugate 1; cells were held at a potential yielding approximately 20% inactivation. “Control” indicates hNav1.7 current in the absence of Homodimeric Conjugate 1 and “Wash” indicates hNav1.7 current following removal of Homodimeric Conjugate 1.

Figure 51:
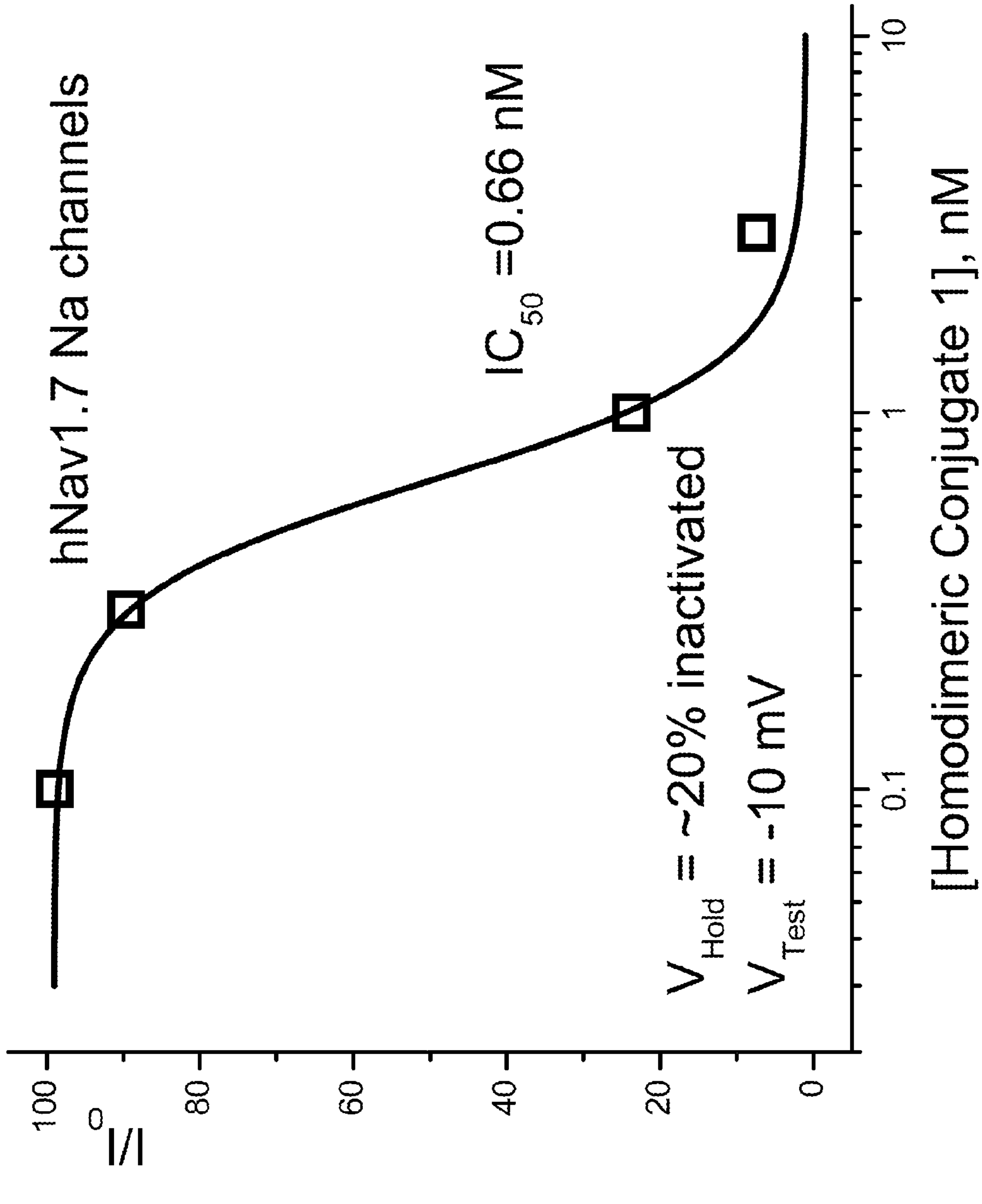

FIG. 51 shows a representative dose-response curve of Homodimeric Conjugate 1 against hNav1.7 channels. Peak inward hNav1.7 currents were measured at −10 mV in the presence of increasing concentrations of Homodimeric Conjugate 1; cells were held at a potential yielding approximately 20% inactivation. The $IC_{50}$ value of Homodimeric Conjugate 1 against TTX-sensitive sodium channels in mDRG neurons was measured to be 0.66 nM. Currents were normalized with 100 representing Nav1.7 current with no peptide addition and 0 representing Nav1.7 current following complete block.

Figure 52:
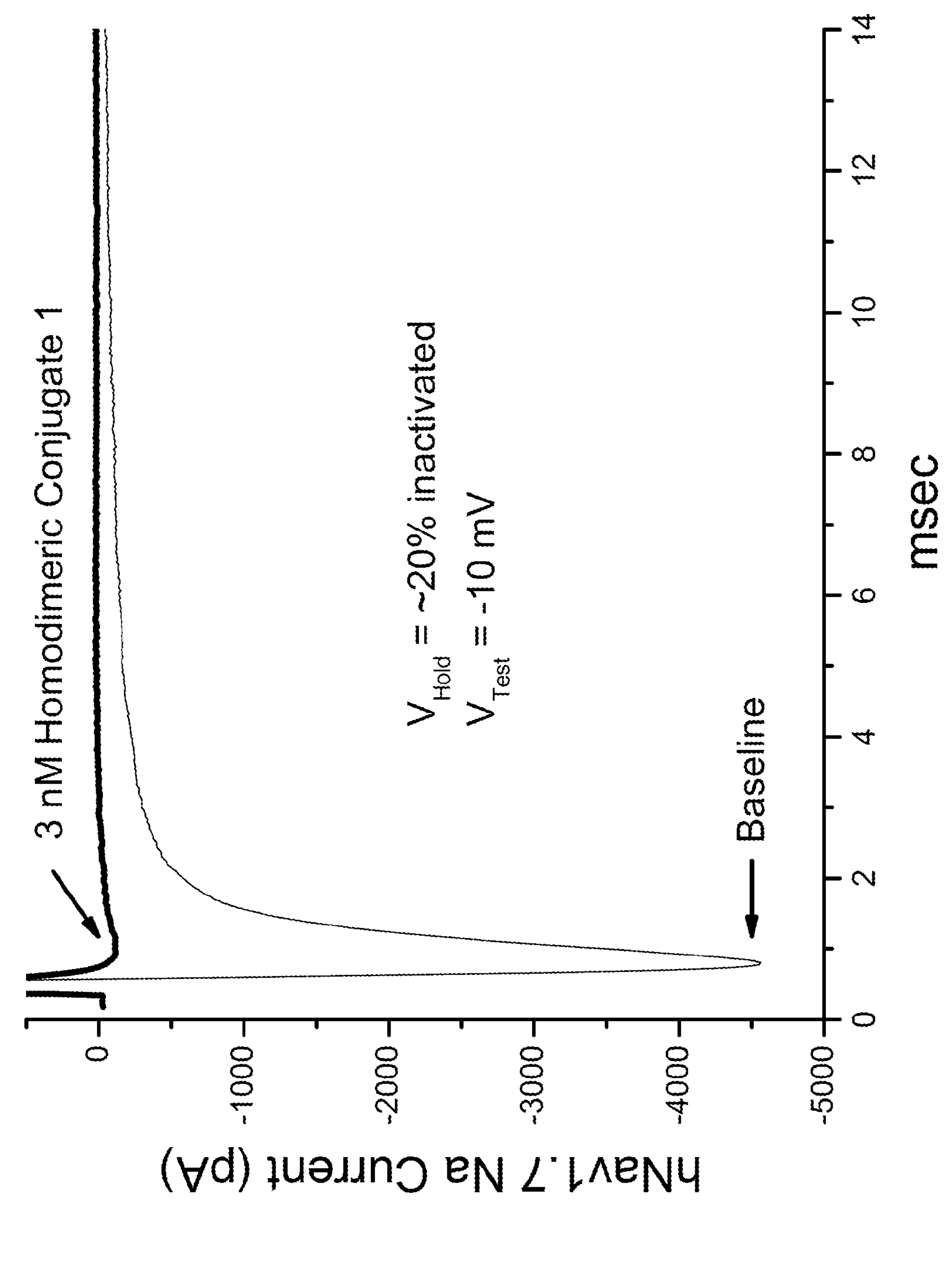

FIG. 52 shows the effect of Homodimeric Conjugate 1 on hNav1.7 channels. Cells were held at a potential yielding approximately 20% inactivation and peak inward hNav1.7 currents were measured at −10 mV. “Baseline” trace shows hNav1.7 current before Homodimeric Conjugate 1 addition, and “3 nM Homodimeric Conjugate 1” trace shows hNav1.7 current after Homodimeric Conjugate 1 addition.

Figure 53:
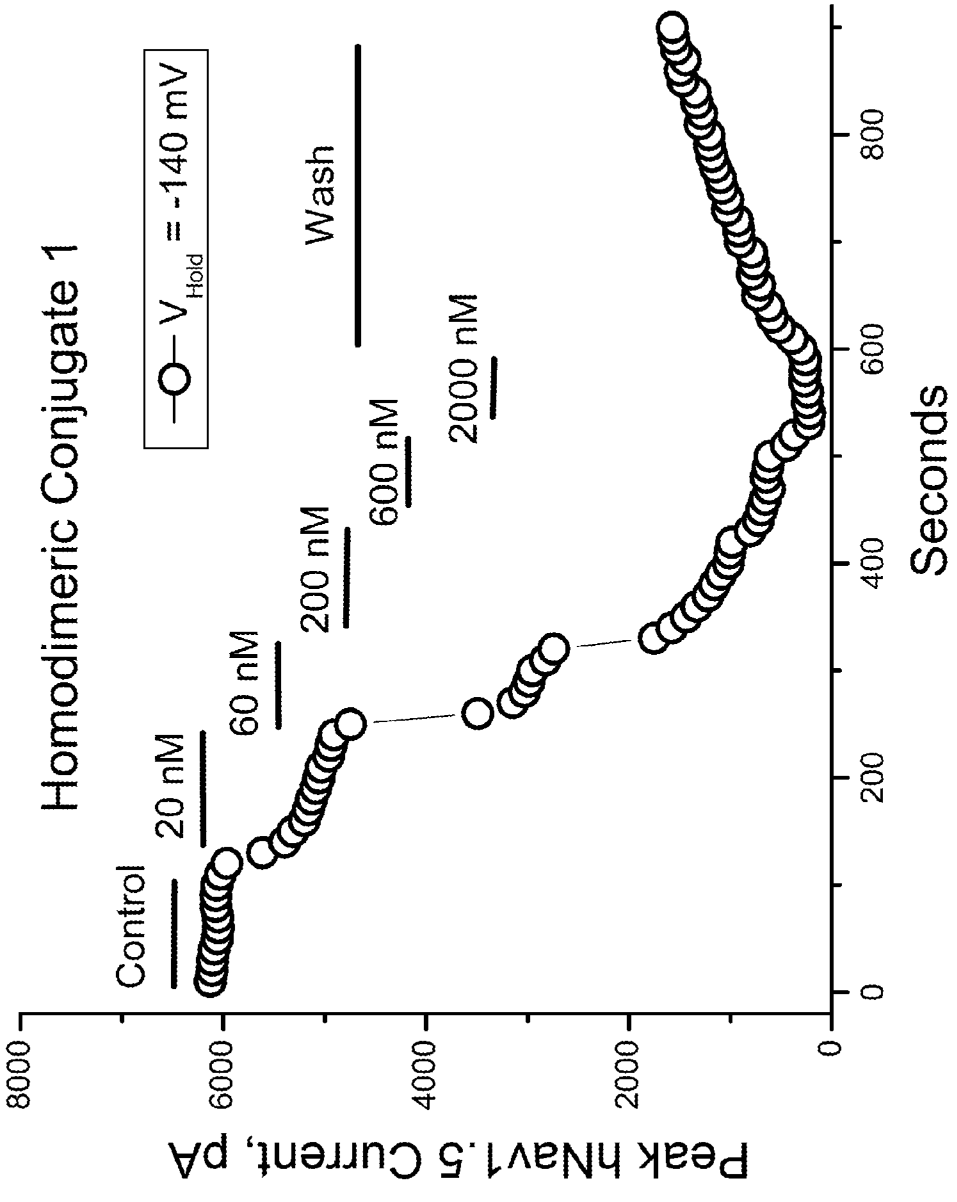

FIG. 53 shows a time course of increasing concentrations of Homodimeric Conjugate 1 against hNav1.5 channels. Peak inward hNav1.5 currents were measured at −10 mV every 10 seconds in the presence of increasing concentrations of Homodimeric Conjugate 1; cells were held at a −140 mV. “Control” indicates hNav1.5 current in the absence of Homodimeric Conjugate 1 and “Wash” indicates hNav1.5 current following removal of Homodimeric Conjugate 1. Note that hNav1.5 currents partially recover following washout of Homodimeric Conjugate 1.

Figure 54:
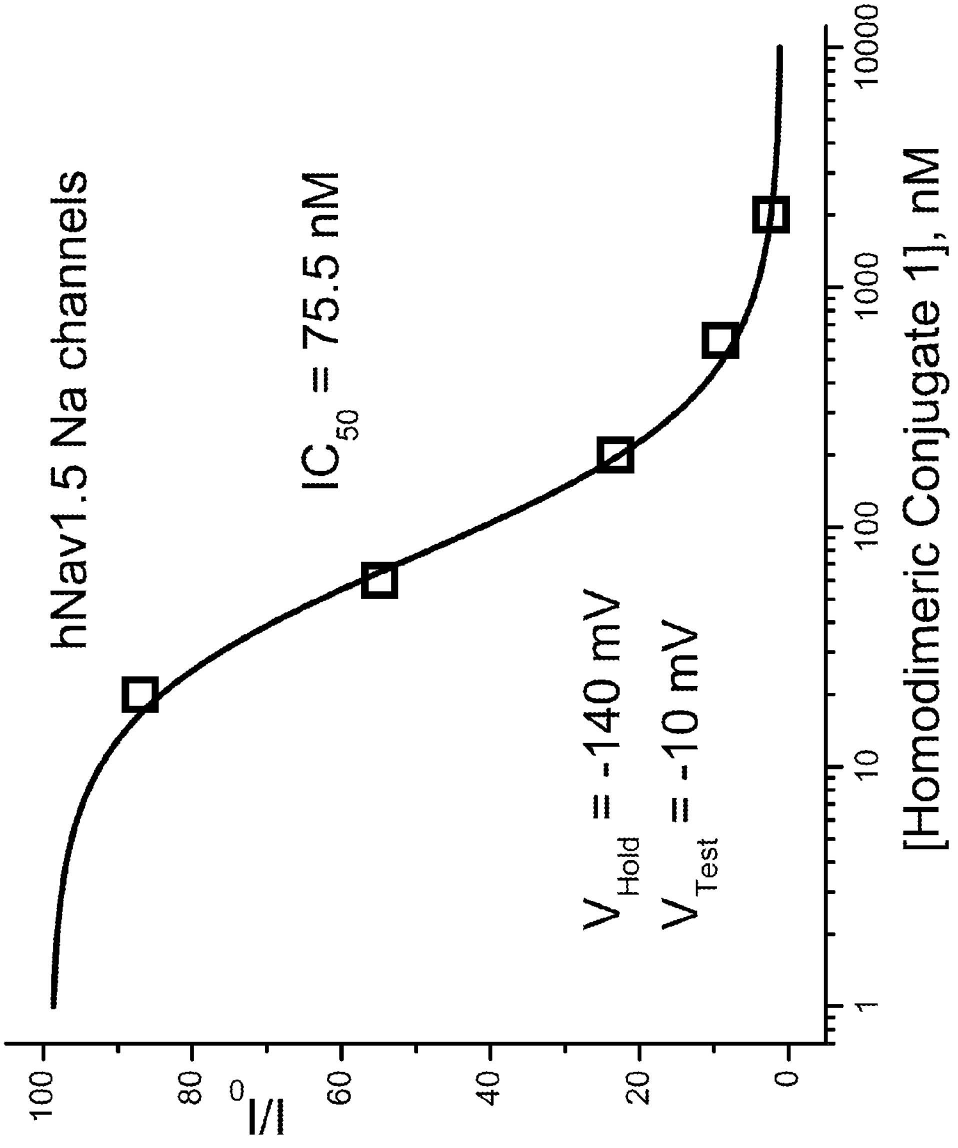

FIG. 54 shows a representative dose-response curve of Homodimeric Conjugate 1 against hNav1.5 channels. Peak inward hNav1.5 currents were measured at −10 mV in the presence of increasing concentrations of Homodimeric Conjugate 1; cells were held at −140 mV. The $IC_{50}$ value of Homodimeric Conjugate 1 against hNav1.5 sodium channels was measured to be 75.5 nM. Currents were normalized with 100 representing Nav1.5 current with no peptide addition and 0 representing Nav1.5 current following complete block.

Figure 55:
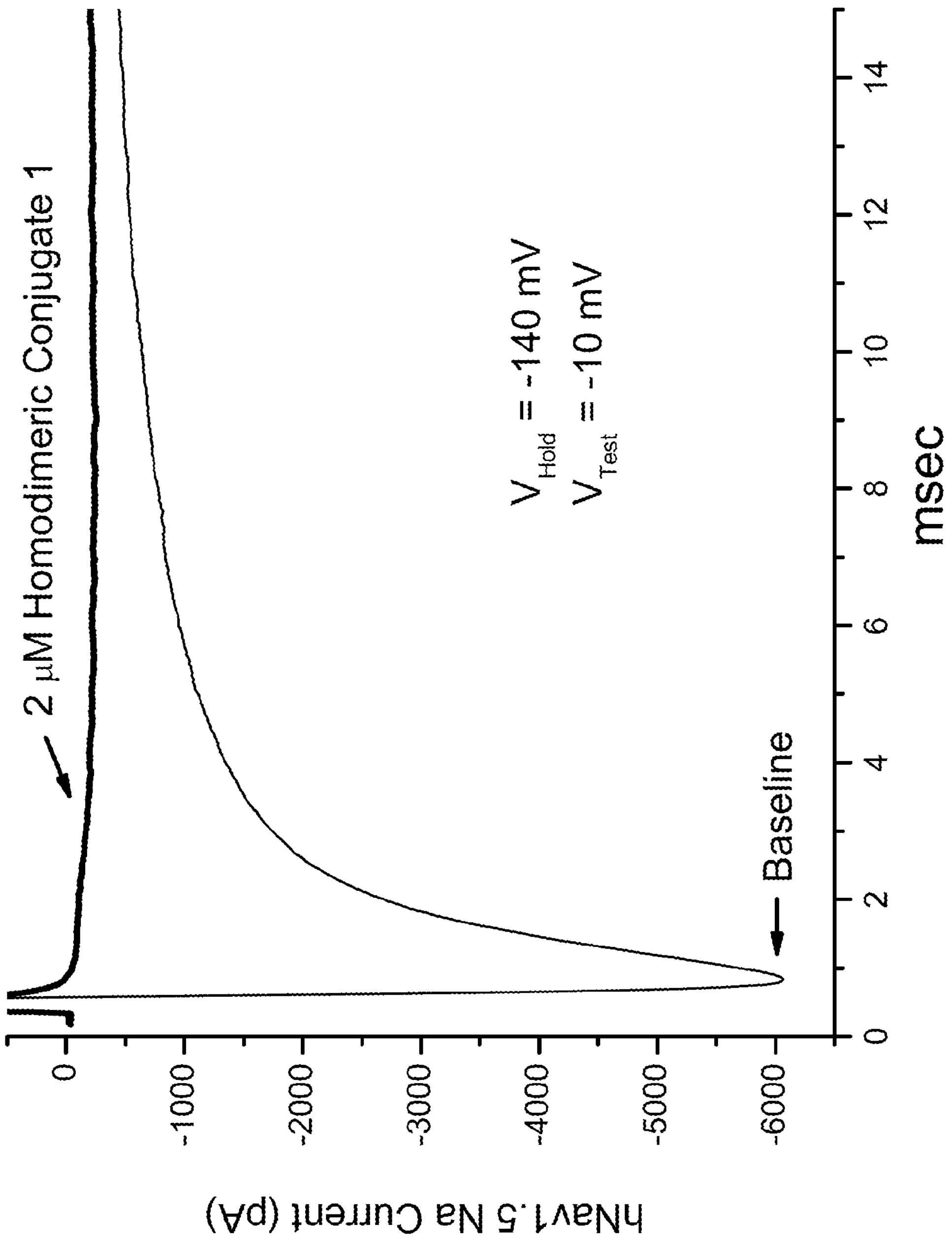

FIG. 55 shows the effect of Homodimeric Conjugate 1 on hNav1.5 channels. Cells were held at −140 mV and peak inward hNav1.5 currents were measured at −10 mV. “Baseline” trace shows hNav1.5 current before Homodimeric Conjugate 1 addition, and “2 μM Homodimeric Conjugate 1” trace shows hNav1.5 current after Homodimeric Conjugate 1 addition.

Figure 56:
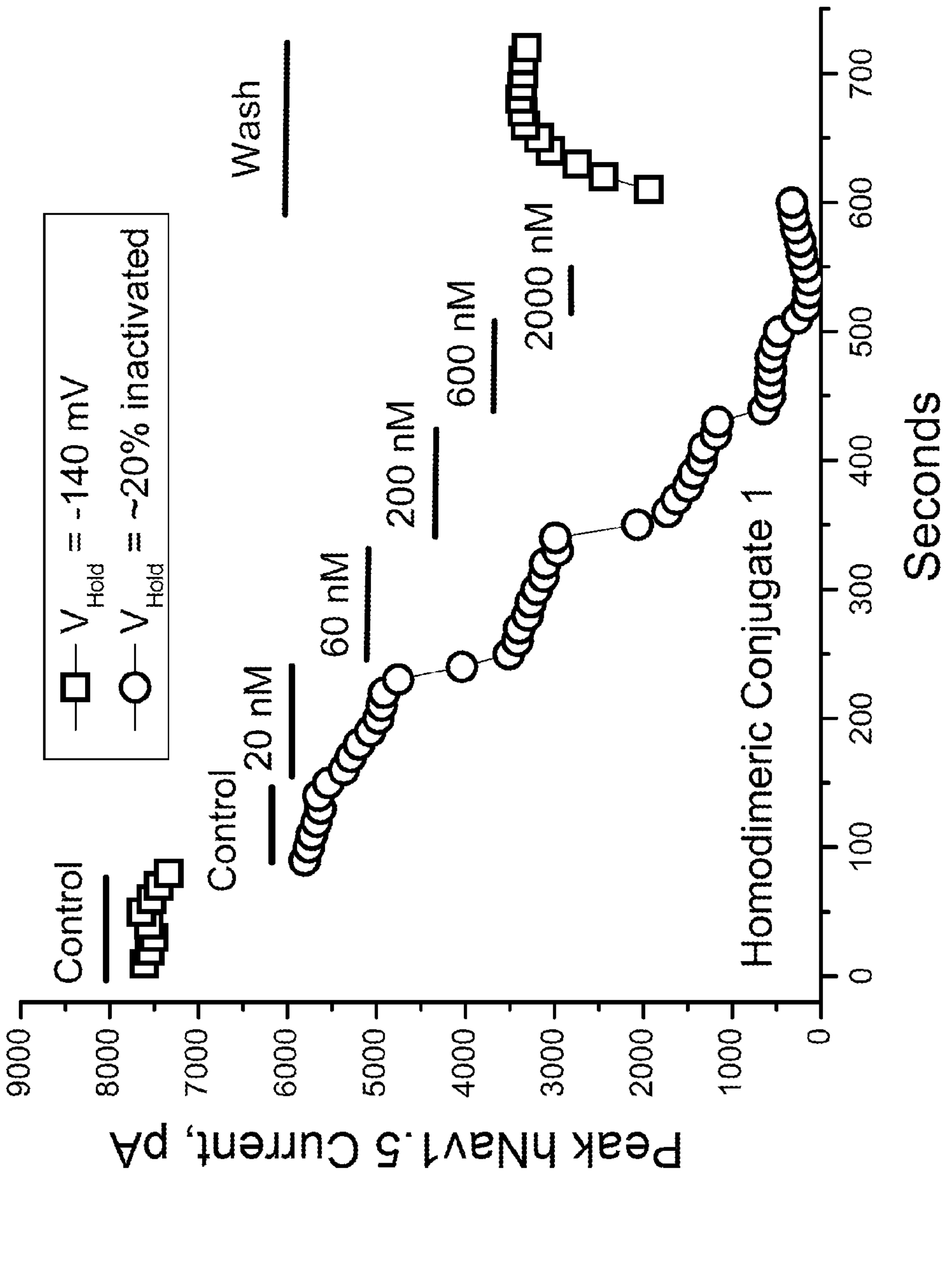

FIG. 56 shows the time course of increasing concentrations of Homodimeric Conjugate 1 against hNav1.5 channels. Peak inward hNav1.5 currents were measured at −10 mV every 10 seconds in the presence of increasing concentrations of Homodimeric Conjugate 1; cells were held at a potential yielding approximately 20% inactivation. “Control” indicates hNav1.5 current in the absence of Homodimeric Conjugate 1 and “Wash” indicates hNav1.5 current following removal of Homodimeric Conjugate 1.

Figure 57:
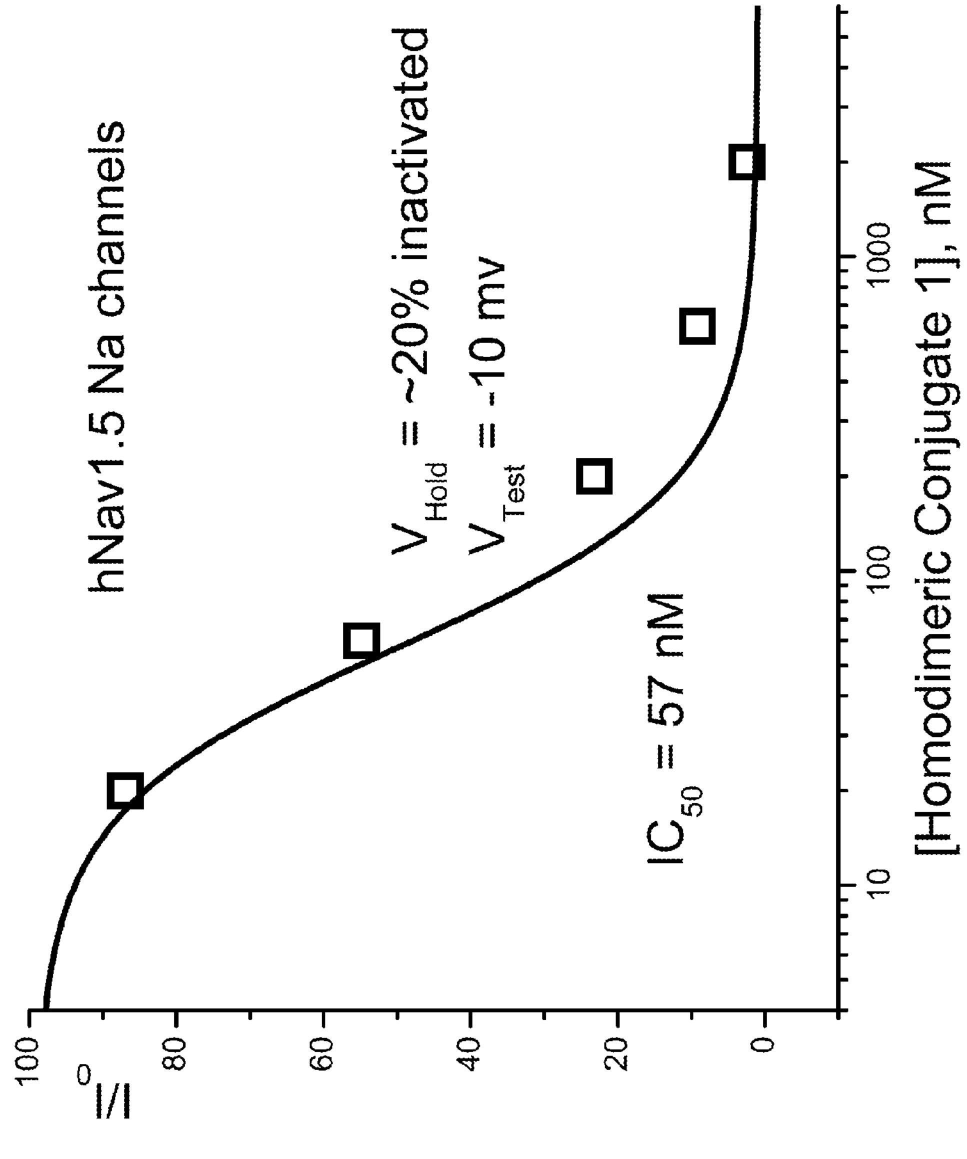

FIG. 57 shows a representative dose-response curve of Homodimeric Conjugate 1 against hNav1.5 channels. Peak inward hNav1.5 currents were measured at −10 mV in the presence of increasing concentrations of Homodimeric Conjugate 1; cells were held at a potential yielding approximately 20% inactivation. The $IC_{50}$ value of Homodimeric Conjugate 1 against hNav1.5 sodium channels was measured to be 57 nM. Currents were normalized with 100 representing Nav1.5 current with no peptide addition and 0 representing Nav1.5 current following complete block.

Figure 58:
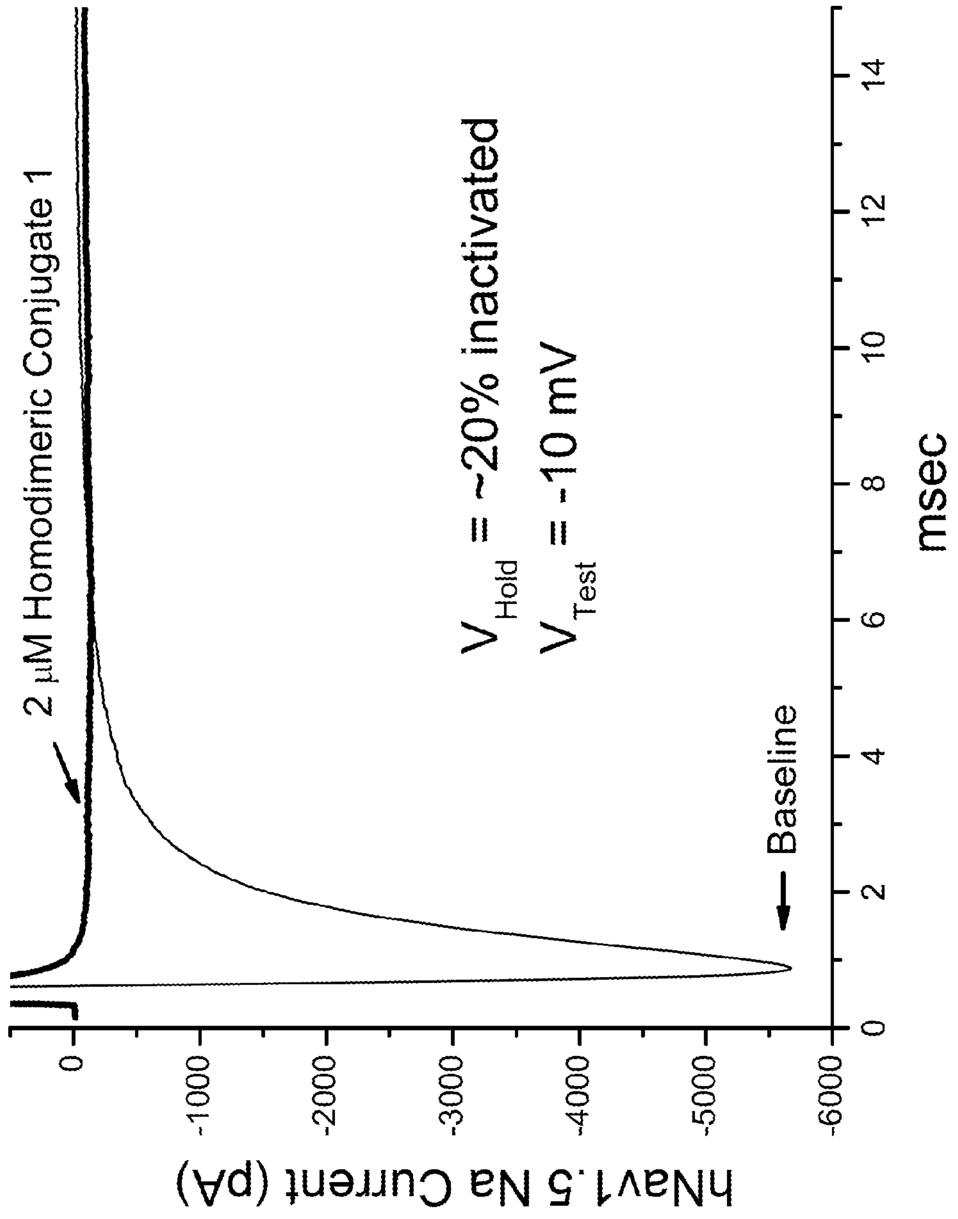

FIG. 58 shows the effect of Homodimeric Conjugate 1 on hNav1.5 channels. Cells were held at a potential yielding approximately 20% inactivation and peak inward hNav1.5 currents were measured at −10 mV. “Baseline” trace shows hNav1.5 current before Homodimeric Conjugate 1 addition, and “2 uM Homodimeric Conjugate 1” trace shows hNav1.5 current after Homodimeric Conjugate 1 addition.

Figure 59:
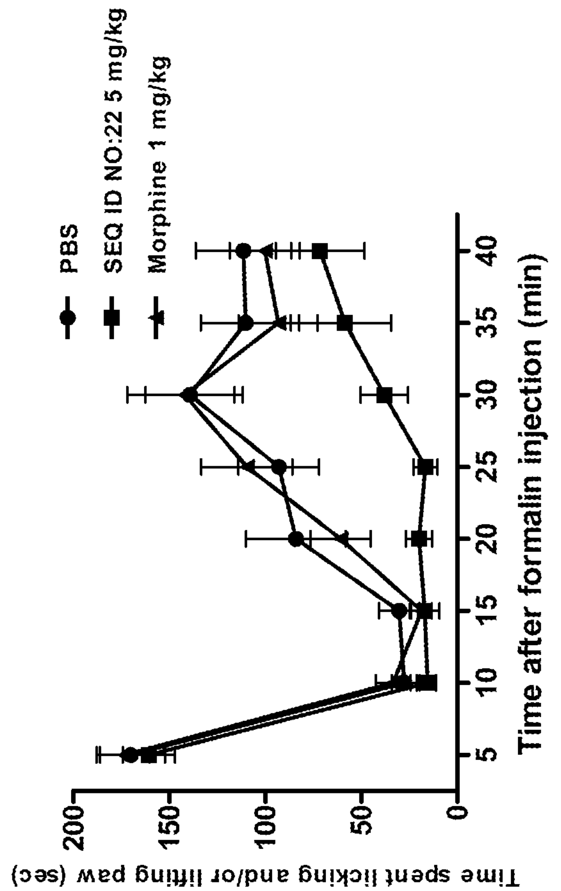

FIG. 59 shows the timecourse of the effect of [Ala5]GpTx-1(1-34) (SEQ ID NO:22) in the formalin pain model in male CD-1 mice with a 1-hour pre-treatment dose of 5 mg/kg s.c. The peptide had no effect in the first or acute phase (0-5 minutes post formalin injection). The peptide significantly reduced the time spent lifting and/or licking the affected paw during the second phase (5-40 minutes post formalin injection, associated with spinal sensitization) compared to vehicle (PBS). In this experiment the 1 mg/kg s.c. dose of morphine used as a positive control was insufficient to significantly reduce pain response in the animals, and it was increased to 3 mg/kg in the following studies. The terminal plasma exposure (peptide plasma concentrations at 45 min post formalin injection) for the peptide was 0.80±0.21 μM.

Figure 60:
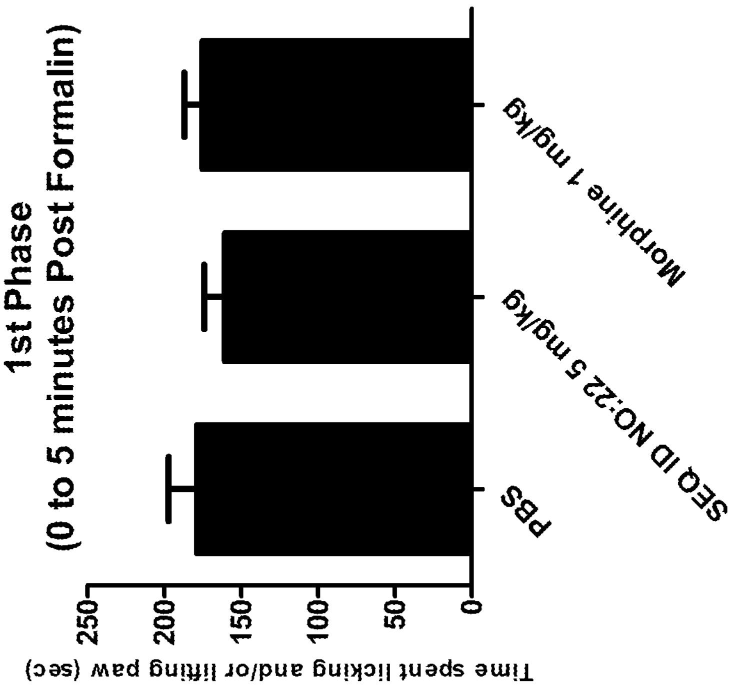

FIG. 60 shows the effect of [Ala5]GpTx-1(1-34) (SEQ ID NO:22) in the formalin pain model in male CD-1 mice with a 1-hour pre-treatment dose of 5 mg/kg s.c. during the first phase (0-5 minutes post formalin injection). Neither the peptide nor the morphine positive control significantly reduced the time spent lifting and/or licking the affected paw during the first phase. Pharmacological reductions in flinching during this first phase generally reflect nonspecific effects on animal movement, consciousness, or health rather than an actual reduction in pain.

Figure 61:
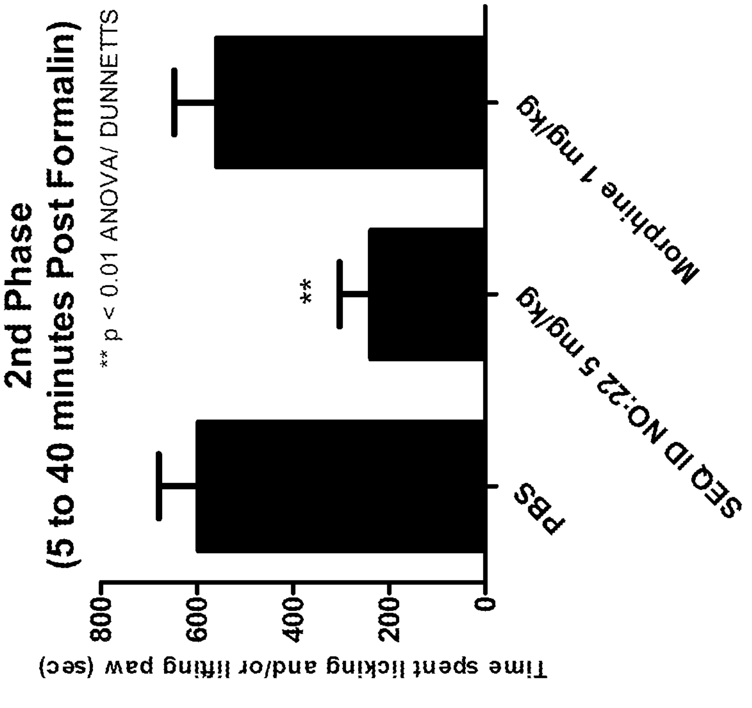

FIG. 61 shows the effect of [Ala5]GpTx-1(1-34) (SEQ ID NO:22) in the formalin pain model in male CD-1 mice with a 1-hour pre-treatment dose of 5 mg/kg s.c. during the second phase (5-40 minutes post formalin injection). The peptide but not the morphine control significantly reduced the time spent lifting and/or licking the affected paw during the second phase. Again, the lack of effect of the morphine positive control does not reflect a "failed" assay, but the variability of mouse responses to this concentration of morphine. Morphine doses for future experiments were increased to 3 mg/kg.

Figure 62:
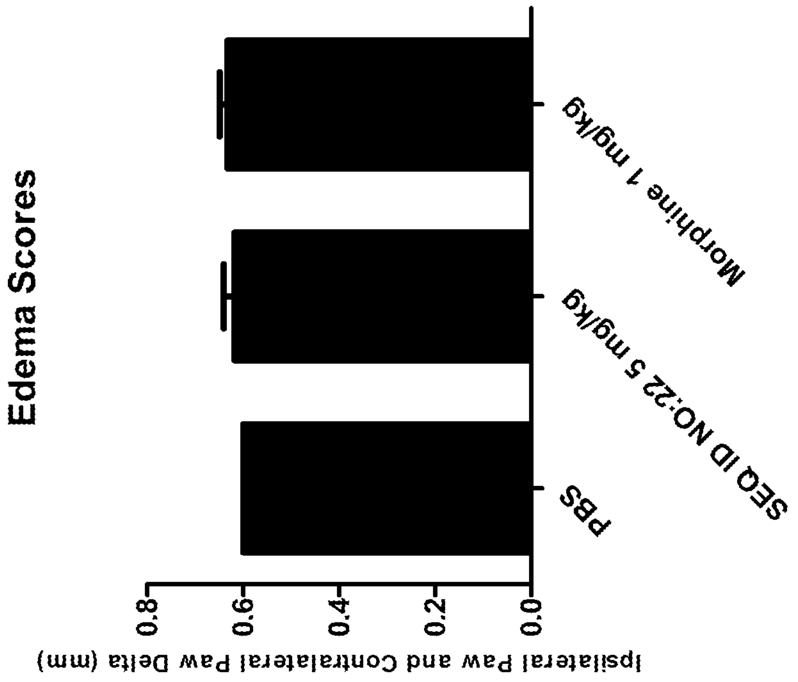

FIG. 62 shows the effect of [Ala5]GpTx-1(1-34) (SEQ ID NO:22) on paw edema in the formalin pain model in male CD-1 mice with a 1-hour pre-treatment dose of 5 mg/kg s.c. Neither the peptide nor the morphine positive control significantly reduced the paw edema caused by formalin injection relative to the vehicle (PBS).

Figure 63:
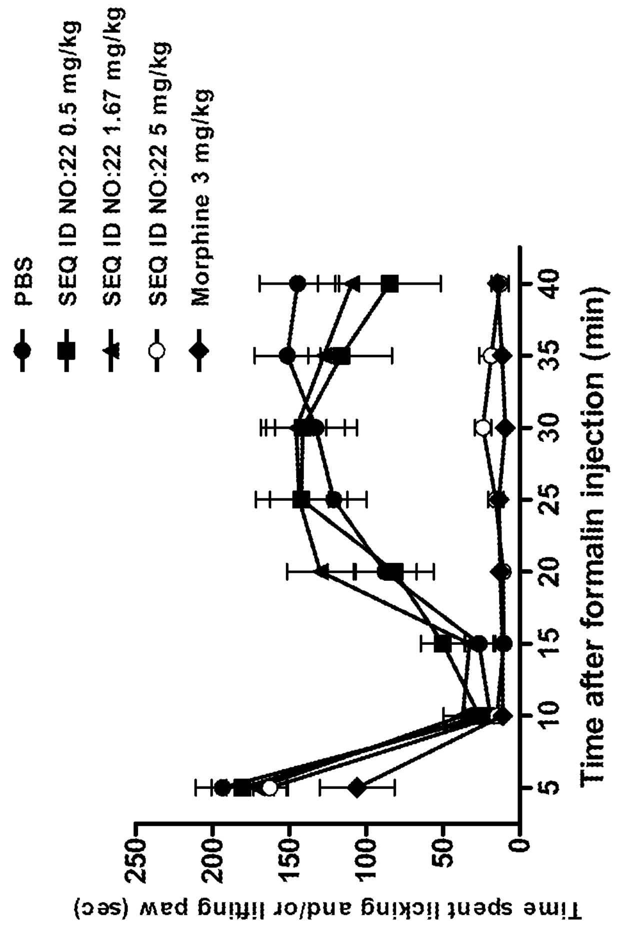

FIG. 63 shows the timecourse of the effect of [Ala5]GpTx-1(1-34) (SEQ ID NO:22) in a repeat of the formalin pain model in male CD-1 mice with 1-hour pre-treatment doses of 5, 1.67, and 0.5 mg/kg s.c. The peptide had no effect at any dose in the first phase (0-5 minutes post formalin injection). The positive control, a 3 mg/kg s.c. dose of morphine, did significantly reduce the time spent lifting/licking the affected paw in the first phase. The 5 mg/kg s.c. dose of [Ala5]GpTx-1(1-34) (SEQ ID NO:22) demonstrated a significant reduction of the time spent lifting/licking in the second phase of the study, as did the morphine positive control. The lower peptide doses (1.67 and 0.5 mg/kg s.c.) had no effect relative to the vehicle in the second phase. Terminal exposures (peptide plasma concentrations at 45 min post formalin injection) were 0.58±0.26 μM, 0.15±0.05 μM, and 0.04±0.2 μM for the 5.0, 1.67, and 0.5 mg/kg doses, respectively.

Figure 64:
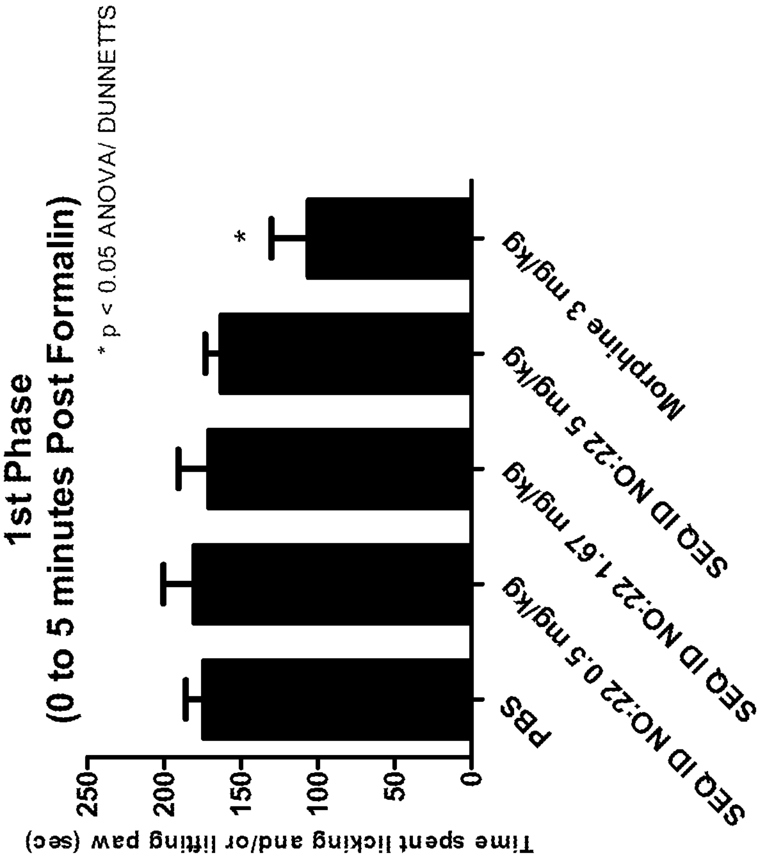

FIG. 64 shows the effect of [Ala5]GpTx-1(1-34) (SEQ ID NO:22) in the first phase of the formalin pain model in male CD-1 mice with 1-hour pre-treatment doses of 5, 1.67, and 0.5 mg/kg s.c. The peptide had no effect at any dose in the first phase (0-5 minutes post formalin injection) relative to the vehicle, but the positive control, a 3 mg/kg s.c. dose of morphine, did significantly reduce the time spent lifting/licking the affected paw in the first phase.

Figure 65:
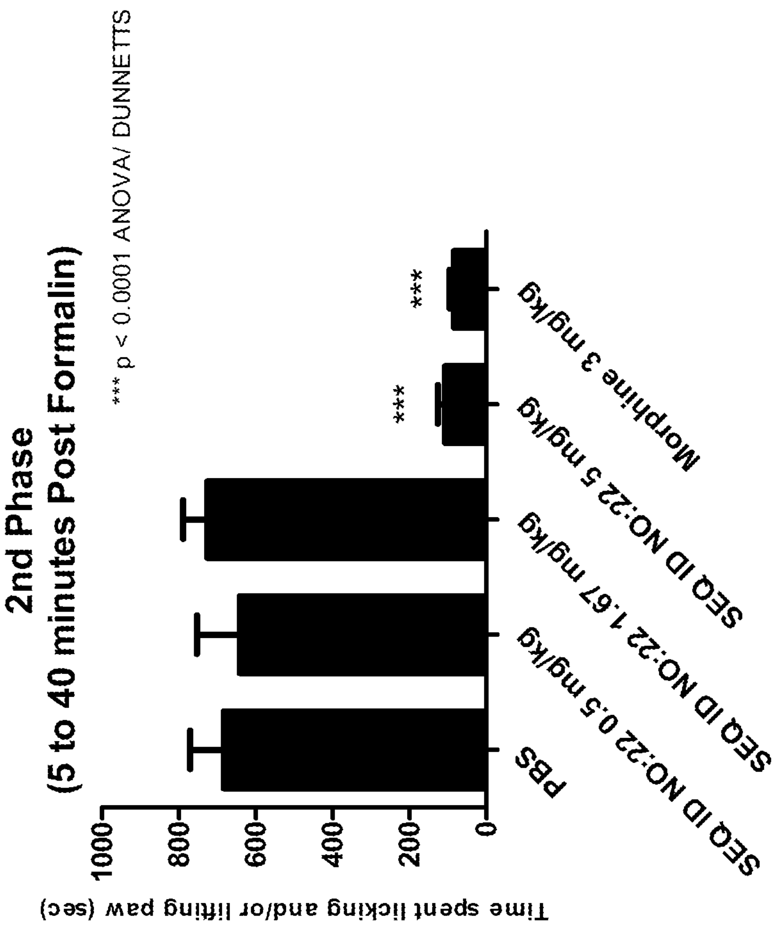

FIG. 65 shows the effect of [Ala5]GpTx-1(1-34) (SEQ ID NO:22) in the second phase of the formalin pain model in male CD-1 mice with 1-hour pre-treatment doses of 5, 1.67, and 0.5 mg/kg s.c. The 5 mg/kg s.c. dose of peptide demonstrated a significant reduction of the time spent lifting/licking in the second phase of the study, as did the morphine positive control. The lower peptide doses (1.67 and 0.5 mg/kg s.c.) had no effect relative to the vehicle in the second phase.

Figure 66:
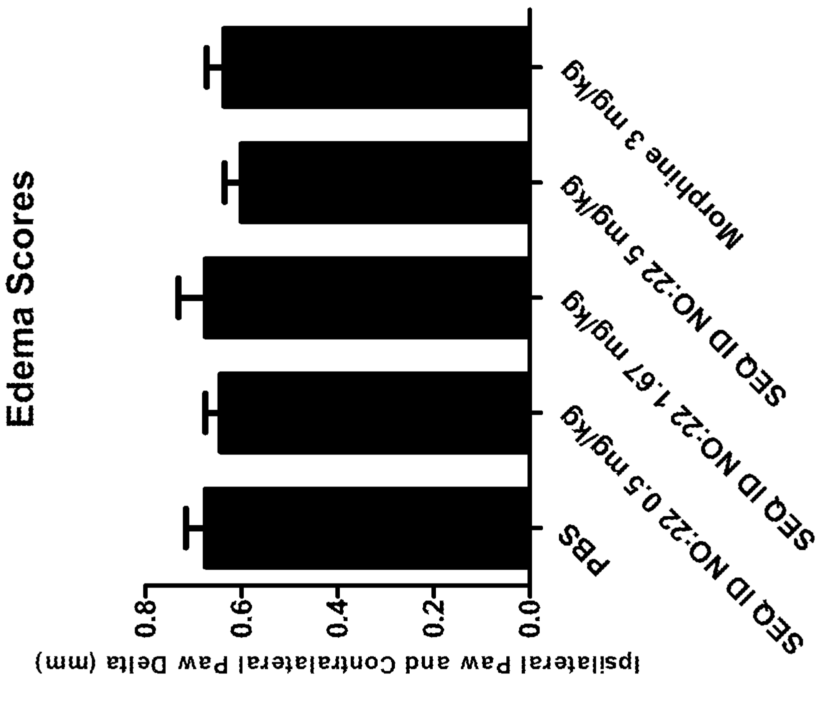

FIG. 66 shows the effect of [Ala5]GpTx-1(1-34) (SEQ ID NO:22) on paw edema in the formalin pain model in male CD-1 mice with a 1-hour pre-treatment doses of 5, 1.67, and 0.5 mg/kg s.c. Neither the peptide nor the morphine control significantly reduced the paw edema caused by formalin injection relative to the vehicle (PBS).

Figure 67:
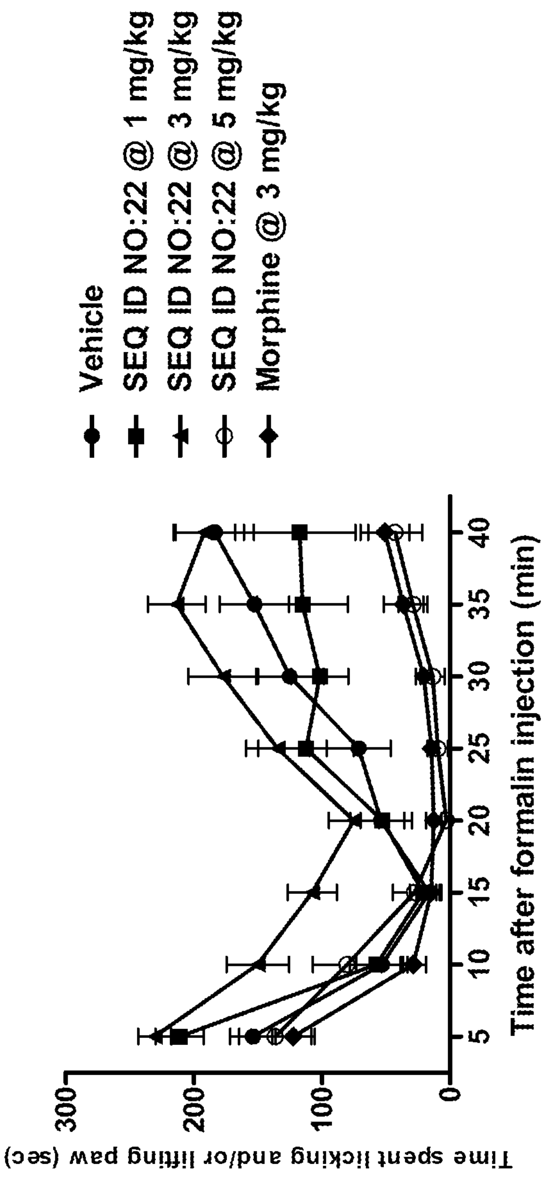

FIG. 67 shows the timecourse of the effect of [Ala5]GpTx-1(1-34) (SEQ ID NO:22) in a third repetition of the formalin pain model in male CD-1 mice with 1-hour pre-treatment doses of 5, 3, and 1 mg/kg s.c. The 5 mg/kg peptide dose and the 3 mg/kg s.c. dose of morphine (30 minutes pretreatment) had no effect in the first phase (0-5 minutes post formalin injection). However, the lower peptide doses (1 and 3 mg/kg s.c.) appeared to increase the time spent lifting/licking relative to the vehicle control. The 5 mg/kg s.c. dose of [Ala5]GpTx-1(1-34) (SEQ ID NO:22) demonstrated a significant reduction of the time spent lifting/licking in the second phase of the study, as did the morphine positive control. However, the lower peptide doses did not show a reduction in lifting/licking behavior relative to the vehicle control in the second phase. The 1 mg/kg s.c. group was not significantly different from the vehicle control, whereas the 3 mg/kg s.c. group appeared to significantly increase time spent lifting/licking in the second phase. Terminal exposures (peptide plasma concentrations at 45 min post formalin injection) were 1.84±0.18 μM, 0.53±0.23 μM, and 0.20±0.05 μM for the 5.0, 3, and 1 mg/kg doses, respectively.

Figure 68:
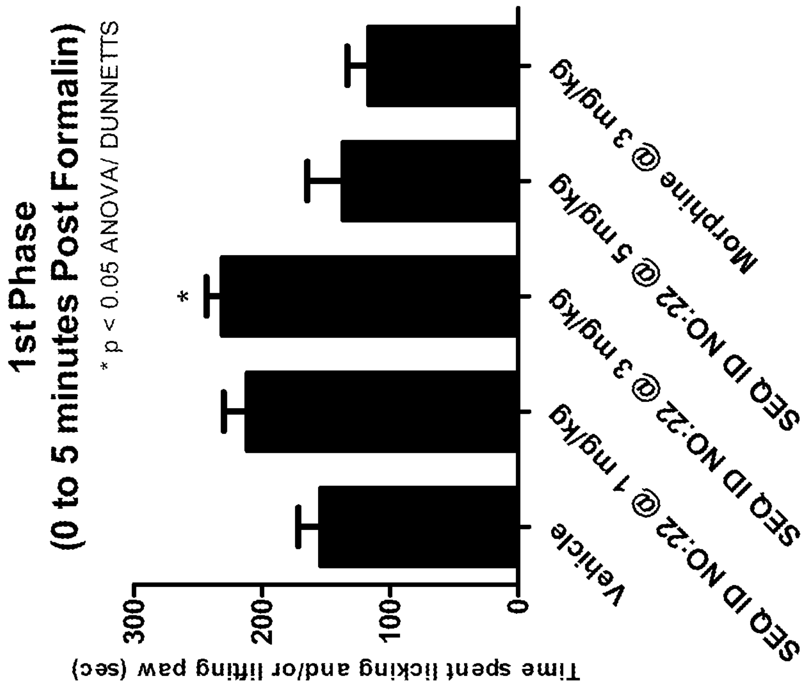

FIG. 68 shows the effect of [Ala5]GpTx-1(1-34) (SEQ ID NO:22) in the first phase of the formalin pain model in male CD-1 mice with 1-hour pre-treatment doses of 5, 3, and 1 mg/kg s.c. The 5 mg/kg peptide dose and the 3 mg/kg s.c. dose of morphine had no effect in the first phase (0-5 minutes post formalin injection). However, the lower peptide doses (1 and 3 mg/kg s.c.) appeared to increase the time spent lifting/licking relative to the control.

Figure 69:
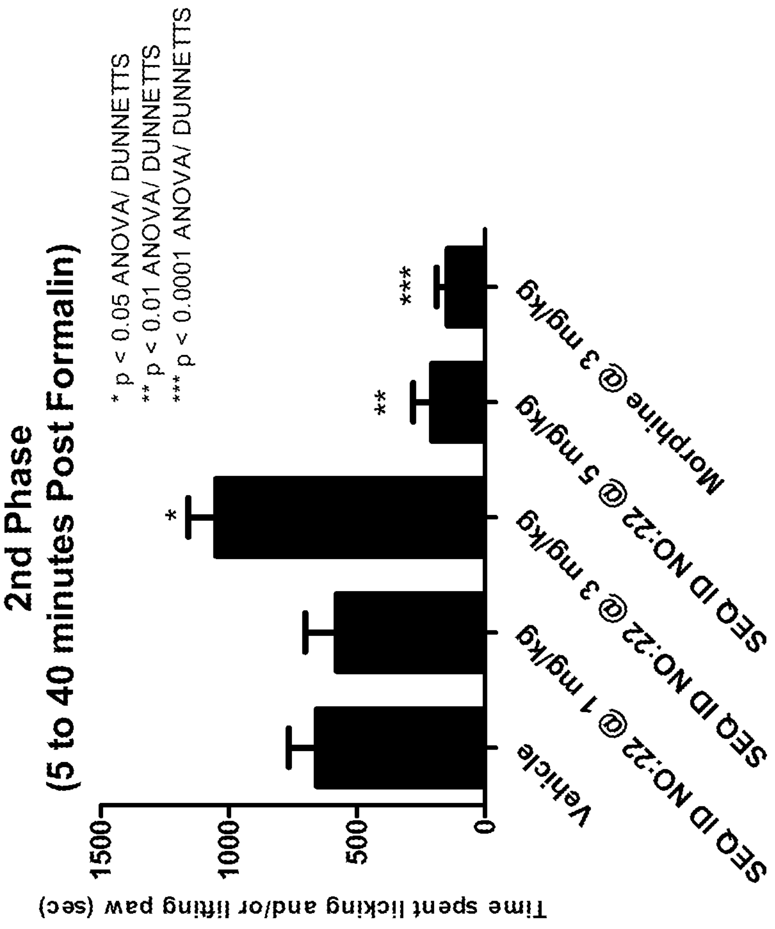

FIG. 69 shows the effect of [Ala5]GpTx-1(1-34) (SEQ ID NO:22) in the second phase of the formalin pain model in male CD-1 mice with 1 hour pre-treatment doses of 5, 3, and 1 mg/kg s.c. The 5 mg/kg s.c. dose of peptide demonstrated a significant reduction of the time spent lifting/licking in the second phase of the study, as did the morphine positive control. However, the lower peptide doses did not show a reduction in lifting/licking behavior relative to the vehicle control in the second phase. The 1 mg/kg s.c. group was not significantly different from the vehicle control, whereas the 3 mg/kg s.c. group appeared to significantly increase the time spent lifting/licking in the second phase.

Figure 70:
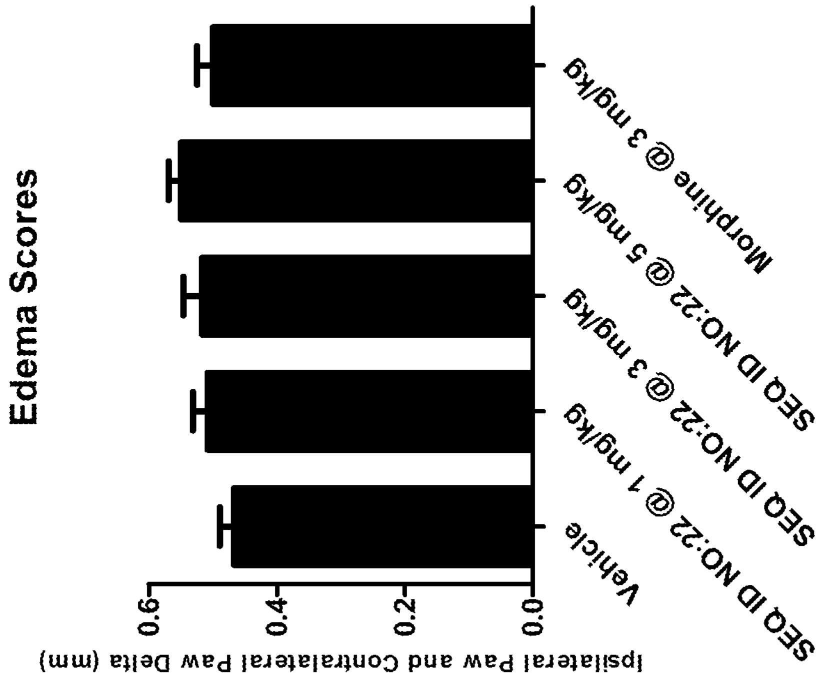

FIG. 70 shows the effect of [Ala5]GpTx-1(1-34) (SEQ ID NO:22) on paw edema in the formalin pain model in male CD-1 mice with a 1-hour pre-treatment doses of 5, 3, and 1 mg/kg s.c. Neither the peptide nor the morphine control significantly reduced the paw edema caused by formalin injection relative to the vehicle (PBS).

Figure 71:
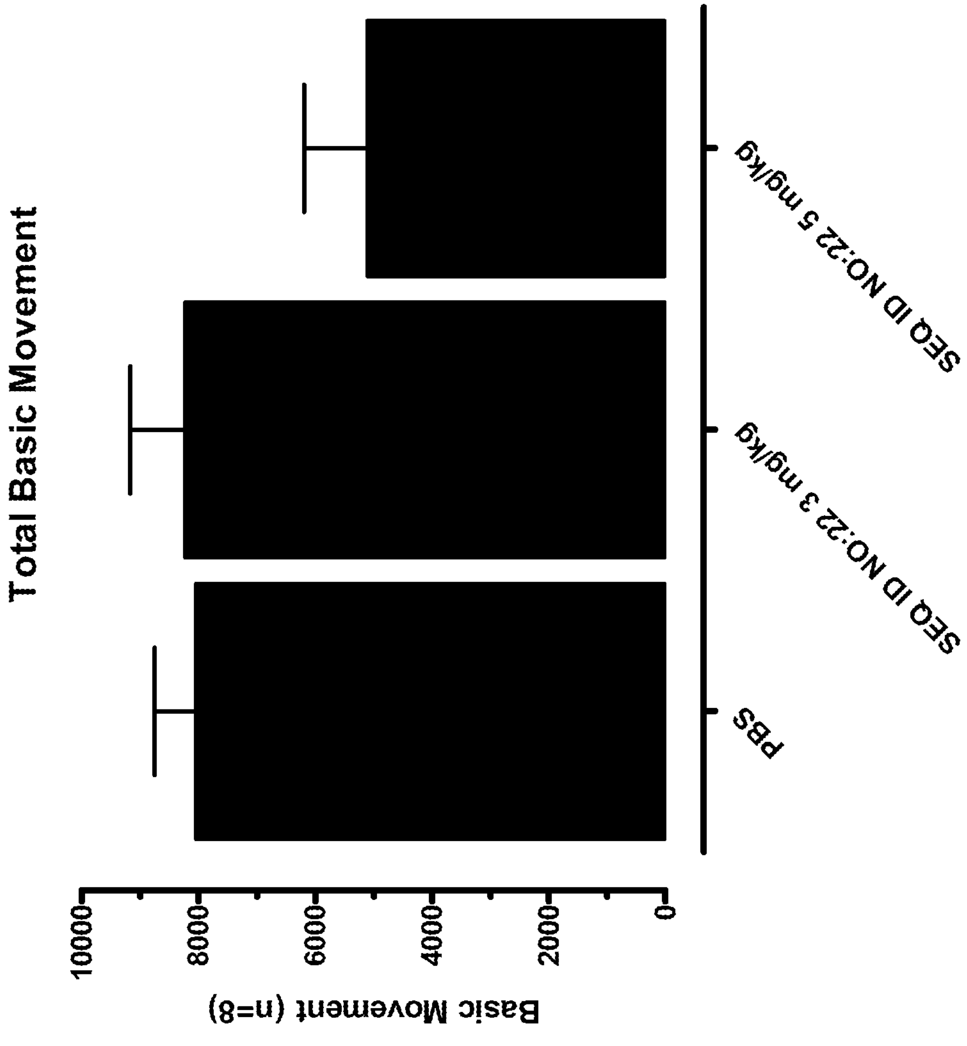

FIG. 71 shows the effects of [Ala5]GpTx-1(1-34) (SEQ ID NO:22) at 3 and 5 mg/kg s.c. doses with a 1-hour pre-treatment time on the total basic movement component of locomotor activity in male CD-1 mice. No doses of peptide significantly decreased exploratory behavior in relation to the vehicle control. Terminal exposures (peptide plasma concentrations at 2 h post peptide injection) were 1.79±0.38 and 0.89±0.33 μM for the 5 and 3 mg/kg s.c. doses, respectively.

Figure 72:
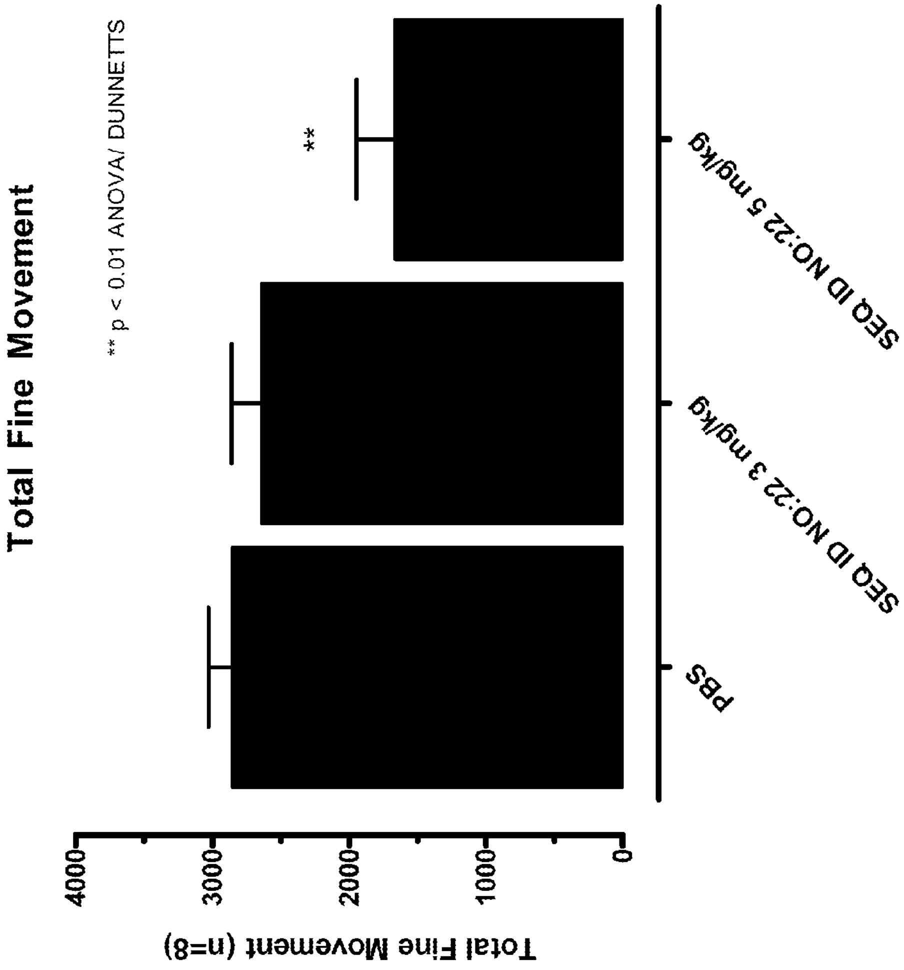

FIG. 72 shows the effects of [Ala5]GpTx-1(1-34) (SEQ ID NO:22) at 3 and 5 mg/kg s.c. doses with a 1-hour pre-treatment time on fine movement component of locomotor activity in male CD-1 mice. At the 3 mg/kg dose, fine movement was not significantly affected. At the 5 mg/kg dose, peptide significantly reduced the total fine movement relative to the vehicle.

Figure 73:
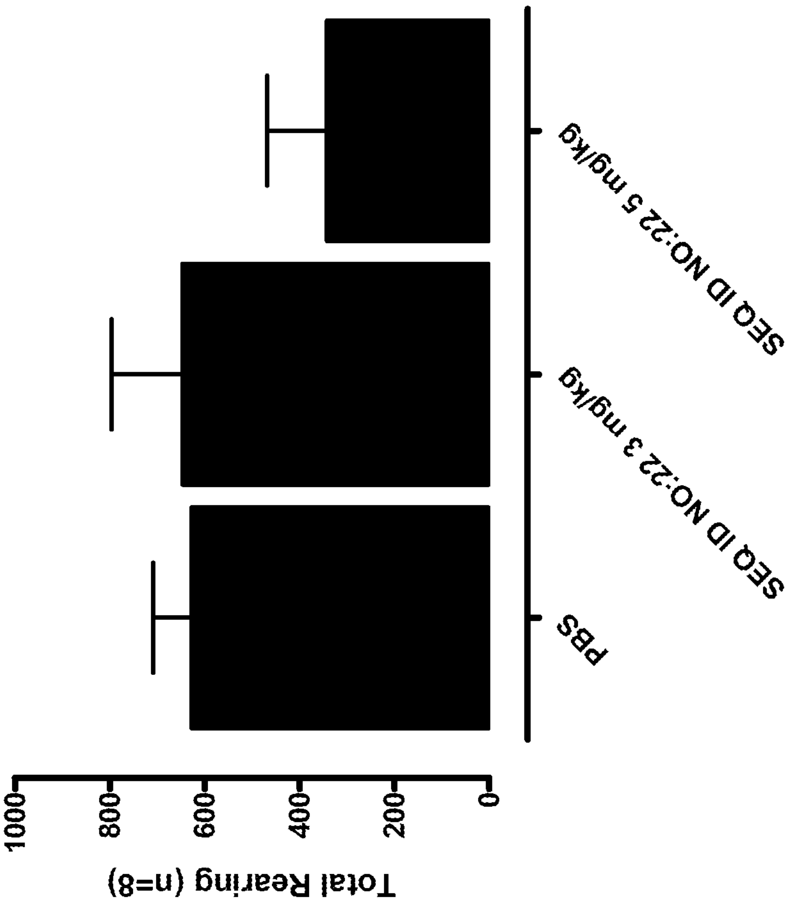

FIG. 73 shows the effects of [Ala5]GpTx-1(1-34) (SEQ ID NO:22) at 3 and 5 mg/kg s.c. doses with a 1-hour pre-treatment time on the total rearing component of locomotor activity in male CD-1 mice. No doses of peptide significantly decreased exploratory behavior in relation to the vehicle control.

Figure 74:
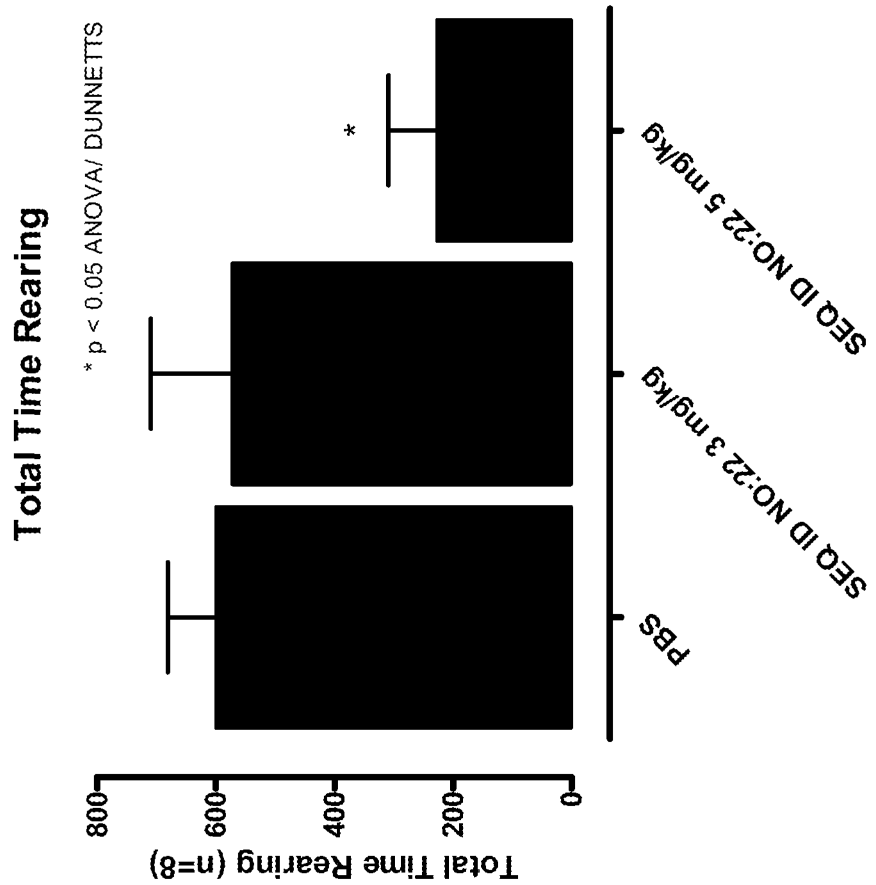

FIG. 74 shows the effects of [Ala5]GpTx-1(1-34) (SEQ ID NO:22) at 3 and 5 mg/kg s.c. doses with a 1-hour pre-treatment time on the total time rearing component of locomotor activity in male CD-1 mice. At the 3 mg/kg dose, total time rearing was not significantly affected. At the 5 mg/kg dose, peptide significantly reduced the total time rearing relative to the vehicle.

Figure 75:
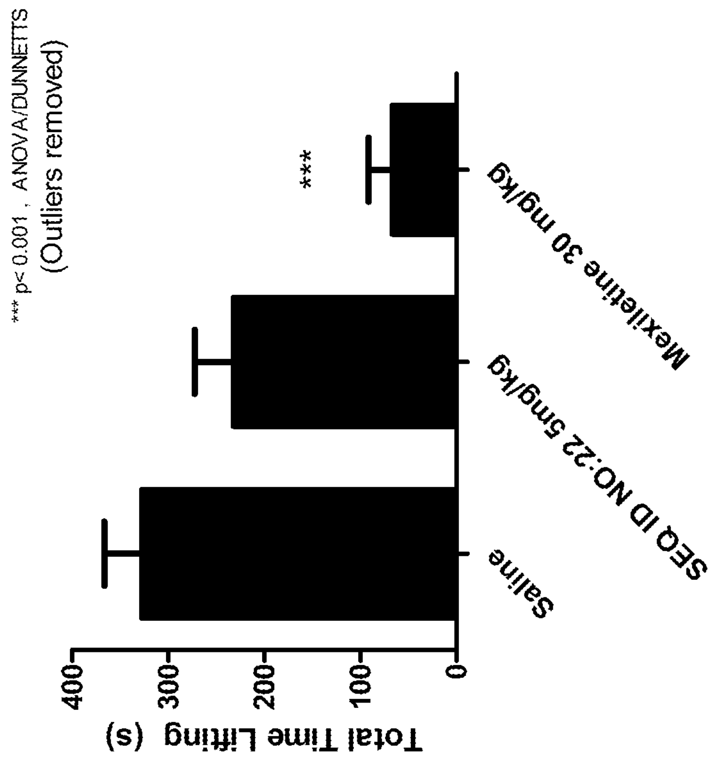

FIG. 75 shows the effect of [Ala5]GpTx-1(1-34) (SEQ ID NO:22) at a 5 mg/kg s.c. dose with a 1-hour pre-treatment time and mexiletine at a 30 mg/kg intraperitoneal ("i.p.") dose with a 30 minute pre-treatment time on the veratridine-induced (1 μg injection in the dorsal paw) spontaneous nociceptive behaviors in male CD-1 mice measured for 20 minutes after veratridine injection. Overall there was a good paw lifting response from the vehicle group that was significantly reversed with mexiletine. At 5 mg/kg, [Ala5]GpTx-1(1-34) (SEQ ID NO:22) did not significantly reduce the lifting behavior. There is no reduction of paw edema across all groups.

Figure 76:
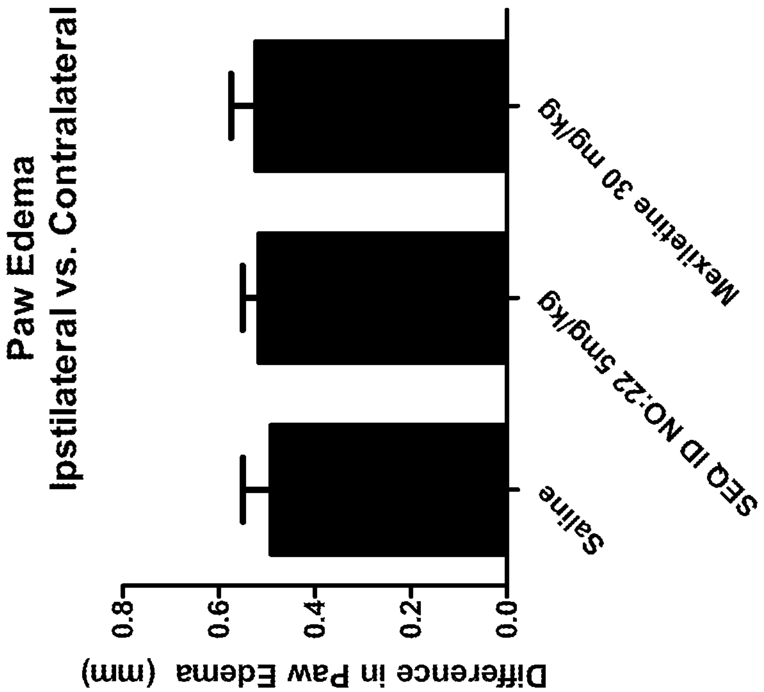

FIG. 76 shows the effect of [Ala5]GpTx-1(1-34) (SEQ ID NO:22) at a 5 mg/kg s.c. dose with a 1-hour pre-treatment time and mexiletine at a 30 mg/kg i.p. dose with a 30 minute pre-treatment time on the veratridine-induced (1 μg injection in the dorsal paw) paw edema in male CD-1 mice. There is no reduction of paw edema across all groups.

Figure 77:
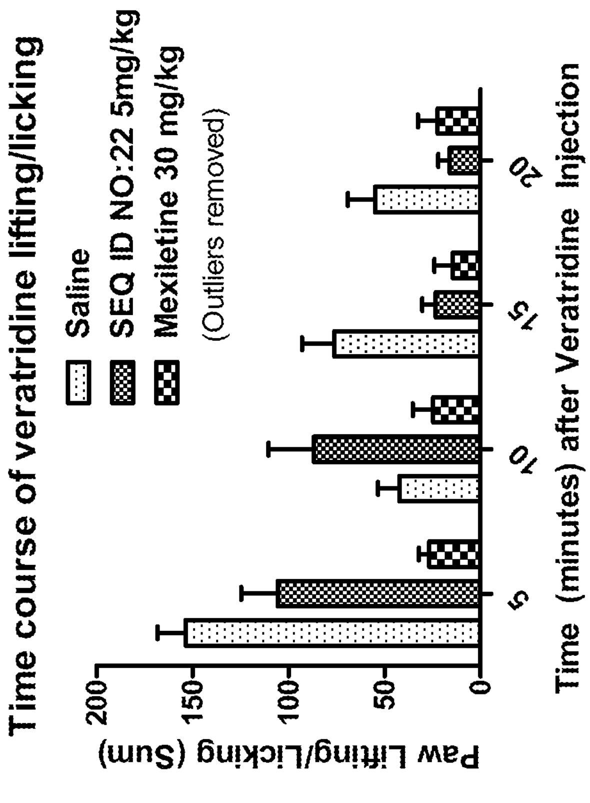

FIG. 77 shows the time course of the effect of [Ala5]GpTx-1(1-34) (SEQ ID NO:22) at a 5 mg/kg s.c. dose with a 1-hour pre-treatment time and mexiletine at a 30 mg/kg i.p. dose with a 30 minute pre-treatment time on the veratridine-induced (1 μg injection in the dorsal paw) spontaneous nociceptive behaviors in male CD-1 mice. Overall there was a good paw lifting response from the vehicle group that was significantly reversed with mexiletine throughout the course of the experiment. At 5 mg/kg, [Ala5]GpTx-1(1-34) (SEQ ID NO:22) was unable to significantly reduce the lifting behavior during the course of the entire experiment, though it did trend toward a reduction in paw lifting and licking during the 10-15 and 15-20 minute time bins. Terminal exposure (peptide plasma concentration at 1.5 h post peptide injection) was 0.70±0.10 μM for the 5 mg/kg dose.

Figure 78:
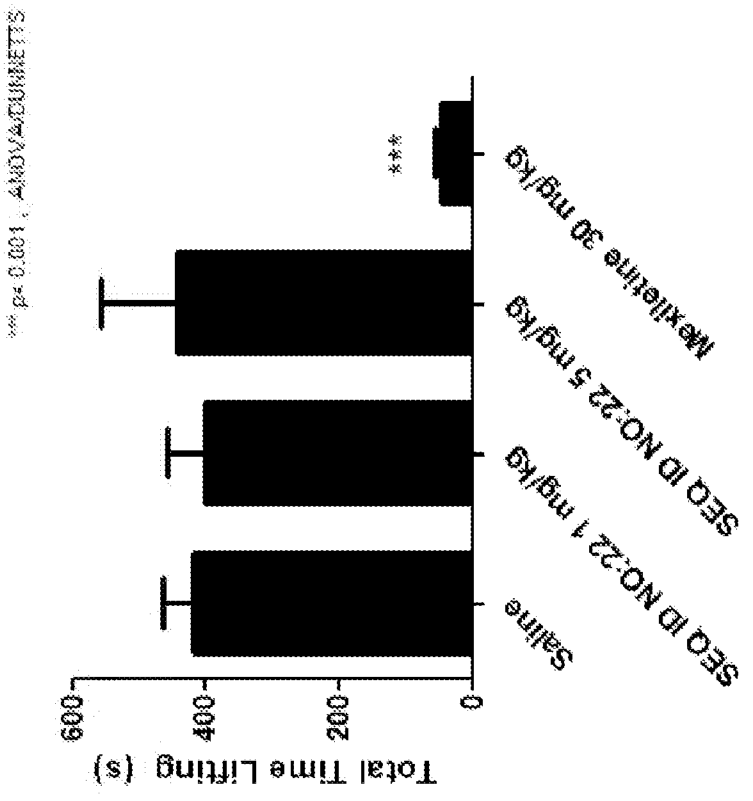

FIG. 78 shows repeat testing of [Ala5]GpTx-1(1-34) (SEQ ID NO:22) at a 1 and 5 mg/kg s.c. doses with a 1-hour pre-treatment time (n=9-10) and mexiletine at a 30 mg/kg i.p. dose with a 30 minute pre-treatment time (n=10) on veratridine-induced (1 μg injection in the dorsal paw) spontaneous nociceptive behaviors in male CD-1 mice. Overall there was a good paw lifting response from the vehicle group that was significantly reversed with mexiletine. At 1 and 5 mg/kg, [Ala5]GpTx-1(1-34) (SEQ ID NO:22) did not significantly reduce the lifting behavior.

Figure 79:
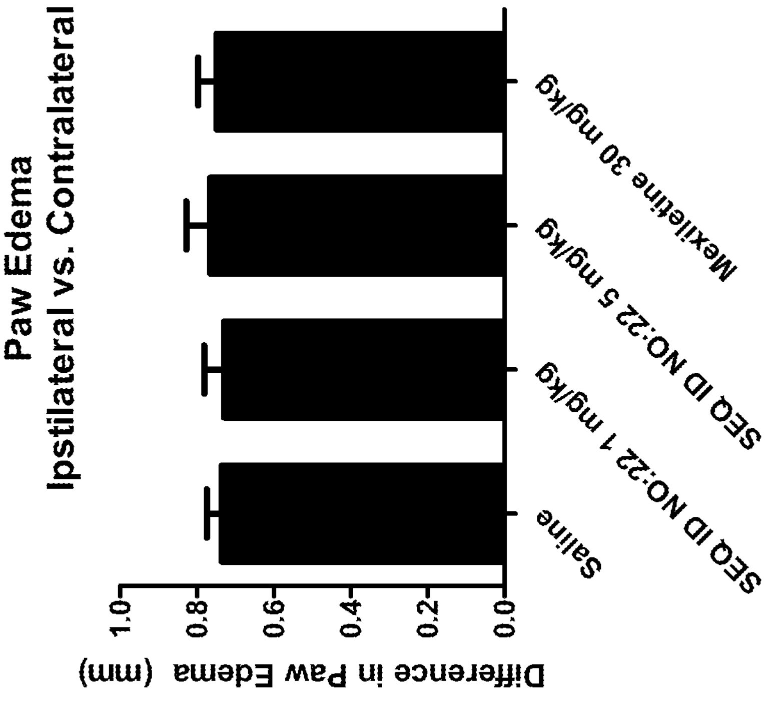

FIG. 79 shows the effect of [Ala5]GpTx-1(1-34) (SEQ ID NO:22) at 1 and 5 mg/kg s.c. doses with a 1-hour pre-treatment time and mexiletine at a 30 mg/kg i.p. dose with a 30 minute pre-treatment time on the veratridine-induced (1 μg injection in the dorsal paw) paw edema in male CD-1 mice. There was no reduction of paw edema in any group.

Figure 80:
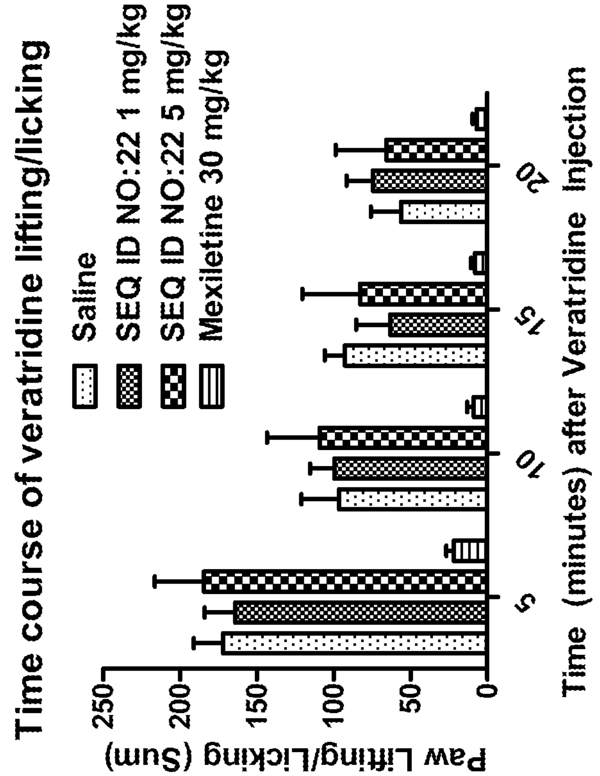

FIG. 80 shows the time course of the effects of [Ala5]GpTx-1(1-34) (SEQ ID NO:22) at 1 and 5 mg/kg s.c. doses with a 1 hour pre-treatment time and mexiletine at a 30 mg/kg i.p. dose with a 30 minute pre-treatment time on the veratridine-induced (1 μg injection in the dorsal paw) spontaneous nociceptive behaviors in male CD-1 mice. Overall there was a good paw lifting response from the vehicle group that was significantly reversed with mexiletine throughout the course of the experiment. At 1 and 5 mg/kg, [Ala5]GpTx-1(1-34) (SEQ ID NO:22) did not significantly reduce the lifting behavior at any point during the course of the experiment. Terminal exposures (peptide plasma concentration at 1.5 h post peptide injection) were 0.72±0.13 and 0.09±0.05 μM for the 5 and 1 mg/kg doses, respectively.

Figure 81A:
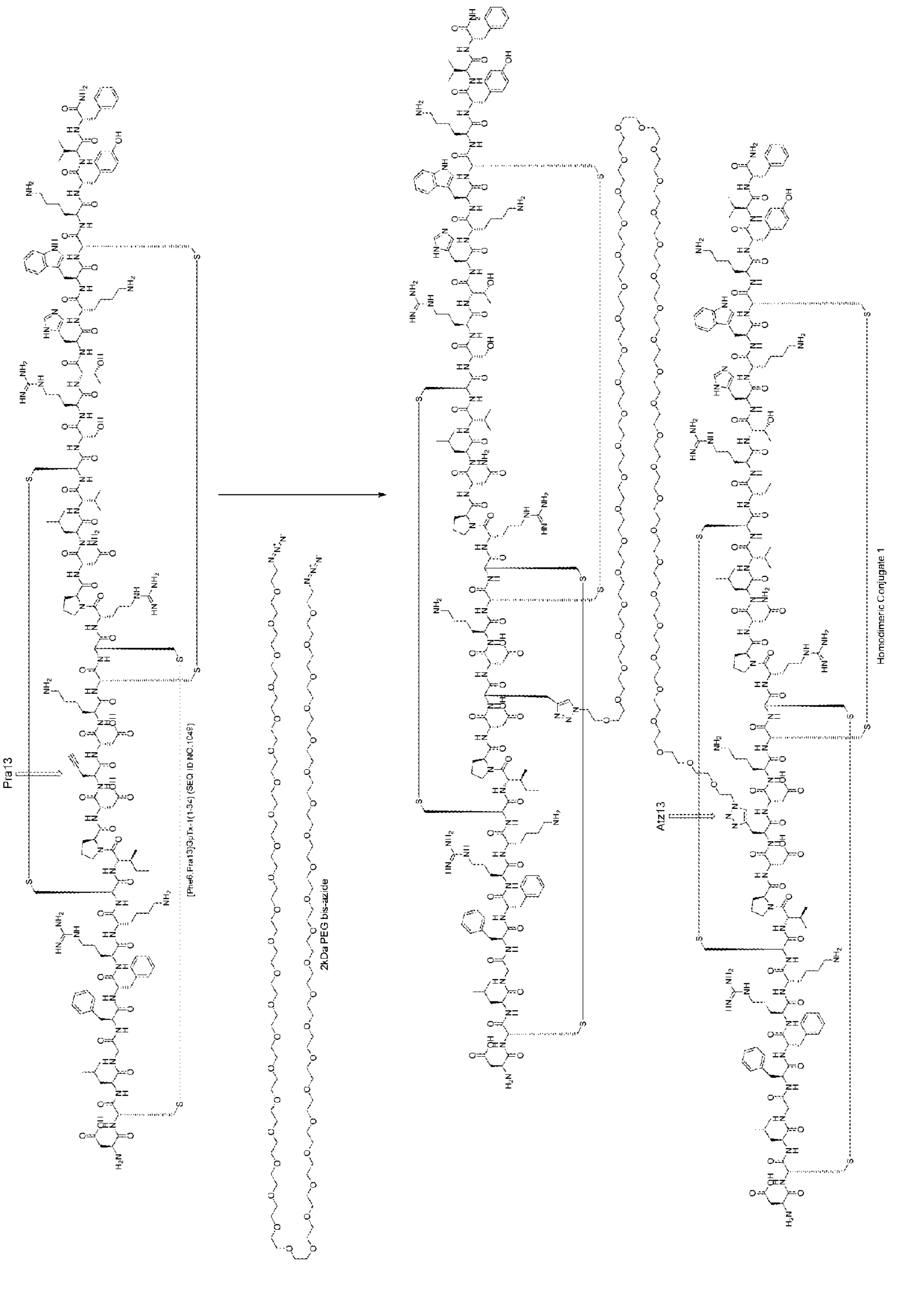

FIG. 81A shows the reaction of alkyne-containing peptide [Phe6; Pra13]GpTx-1(1-34) (SEQ ID NO:1049) with a 2 kDa PEG bis-azide via a copper catalyzed 1,3-dipolar cycloaddition reaction to obtain the site-specific homodimeric peptide with two triazole linkages by converting the propargylglycine or Pra residues in the sequences to 3-(1,2,3-triazol-4-yl)alanine or Atz residues.

Figure 81B:
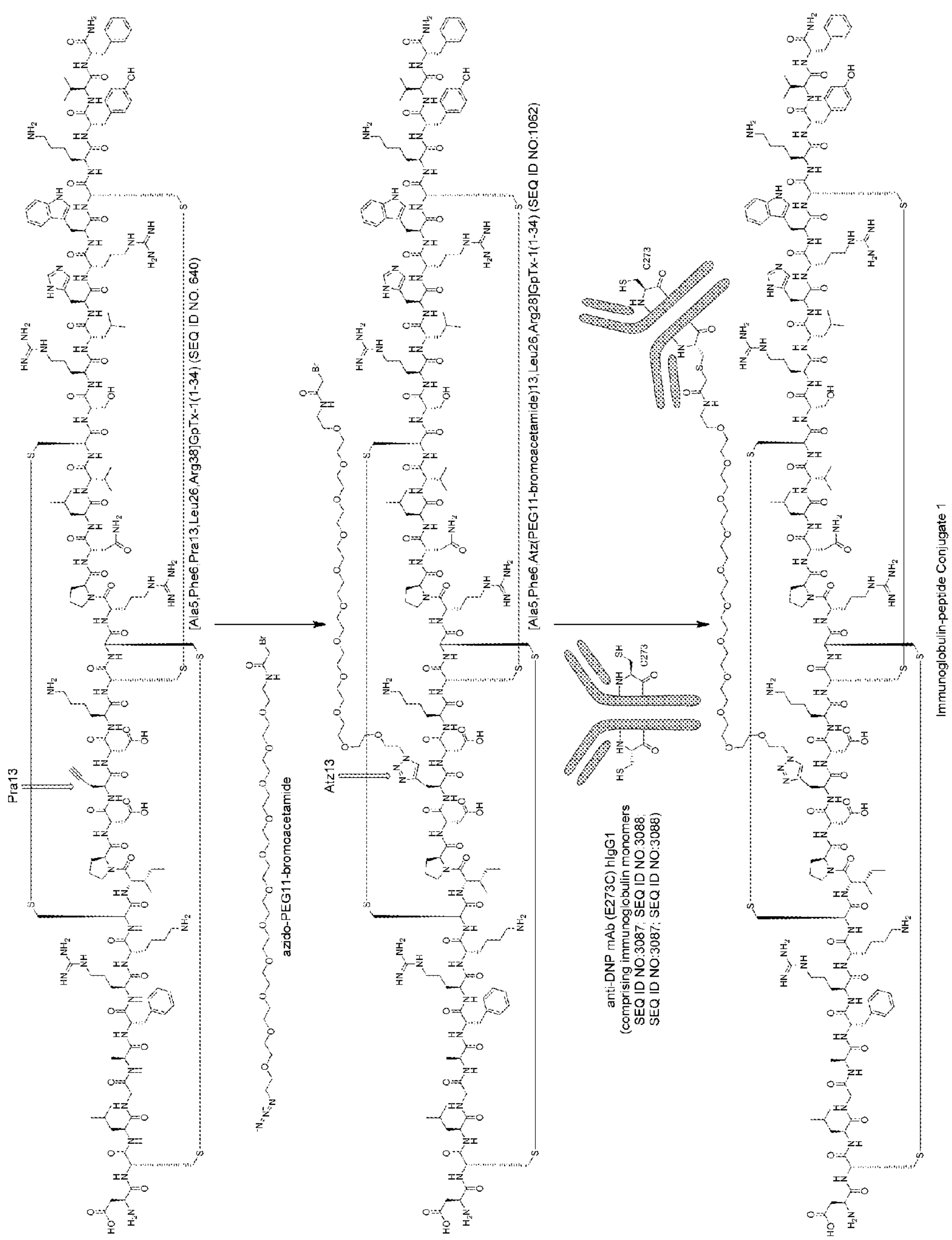

FIG. 81B shows the two step sequence of first reacting an alkyne-containing peptide [Ala5,Phe6,Pra13,Leu26,Arg28]GpTx-1(1-34) (SEQ ID NO:640) with an azido-PEG11-bromoacetamide linker via a copper catalyzed 1,3-dipolar cycloaddition reaction to obtain the site-specifically PEGylated peptide-linker construct (SEQ ID NO:1062) with a triazole linkage by converting the propargylglycine or Pra residue in the peptide sequence to a 3-(1,2,3-triazol-4-yl)alanine or Atz residue. Second, the engineered free cysteines in the anti-DNP mAb (E273C) hIgG1 (comprising immunoglobulin monomers SEQ ID NO:3087; SEQ ID NO:3088; SEQ ID NO:3087; SEQ ID NO:3088) react with the bromoacetamide functionality in peptide-linker to form a site-specific immunoglobulin-peptide conjugate with a stable thioacetamide linkage (Immunoglobulin-peptide Conjugate 1). If one cysteine reacts, then the result is a monovalent immunoglobulin-peptide conjugate as represented, but if both cysteines react, then the result is a bivalent immunoglobulin-peptide conjugate.

Figure 82:
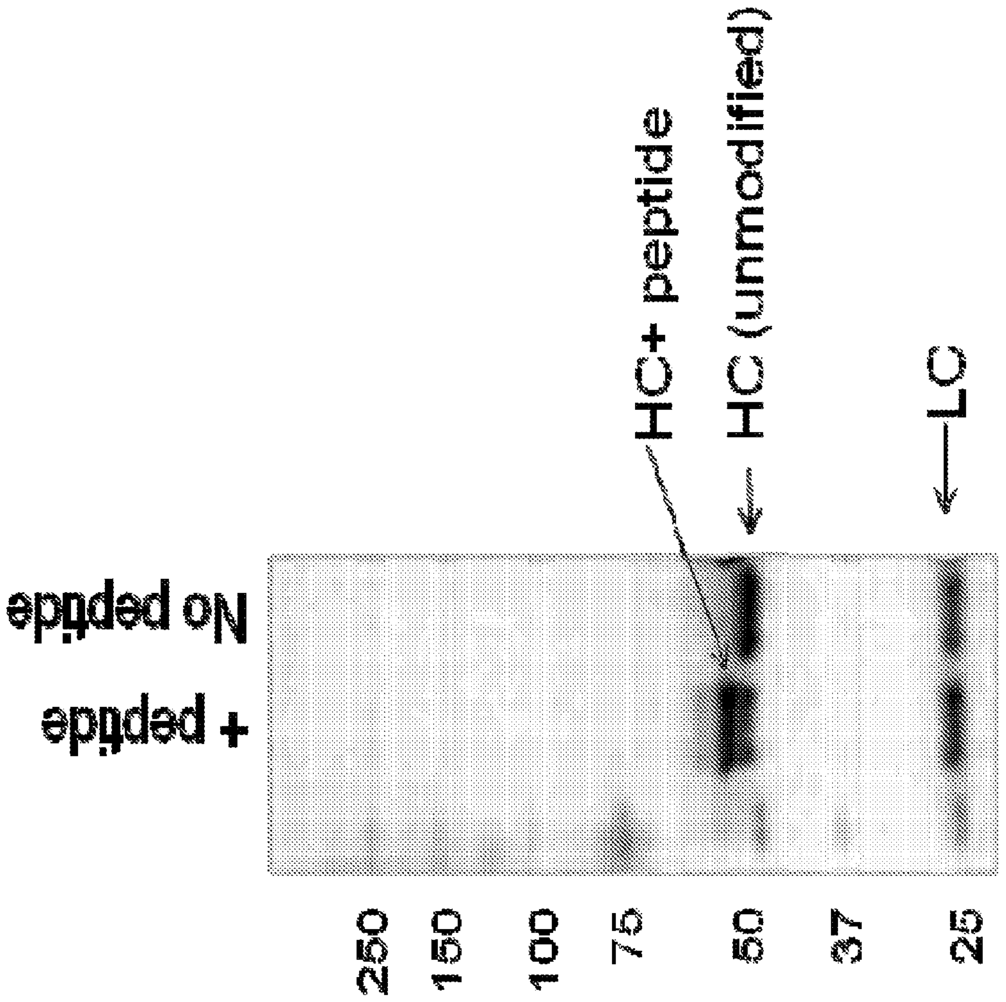

FIG. 82 shows a reducing SDS-PAGE gel of the site specific conjugation reaction mixture of peptide-linker construct (SEQ ID NO:1062) with anti-DNP mAb (E273C) hIgG1 (comprising immunoglobulin monomers SEQ ID NO:3087; SEQ ID NO:3088; SEQ ID NO:3087; SEQ ID NO:3088) prior to purification on the SP-column. Approximately 75% of mAb heavy chain (HC) shows a 5-kD shift, indicating conjugation of a single GpTX-1 peptide analog. The higher molecular weight band indicates higher order conjugate due to over reduction.

Figure 83:
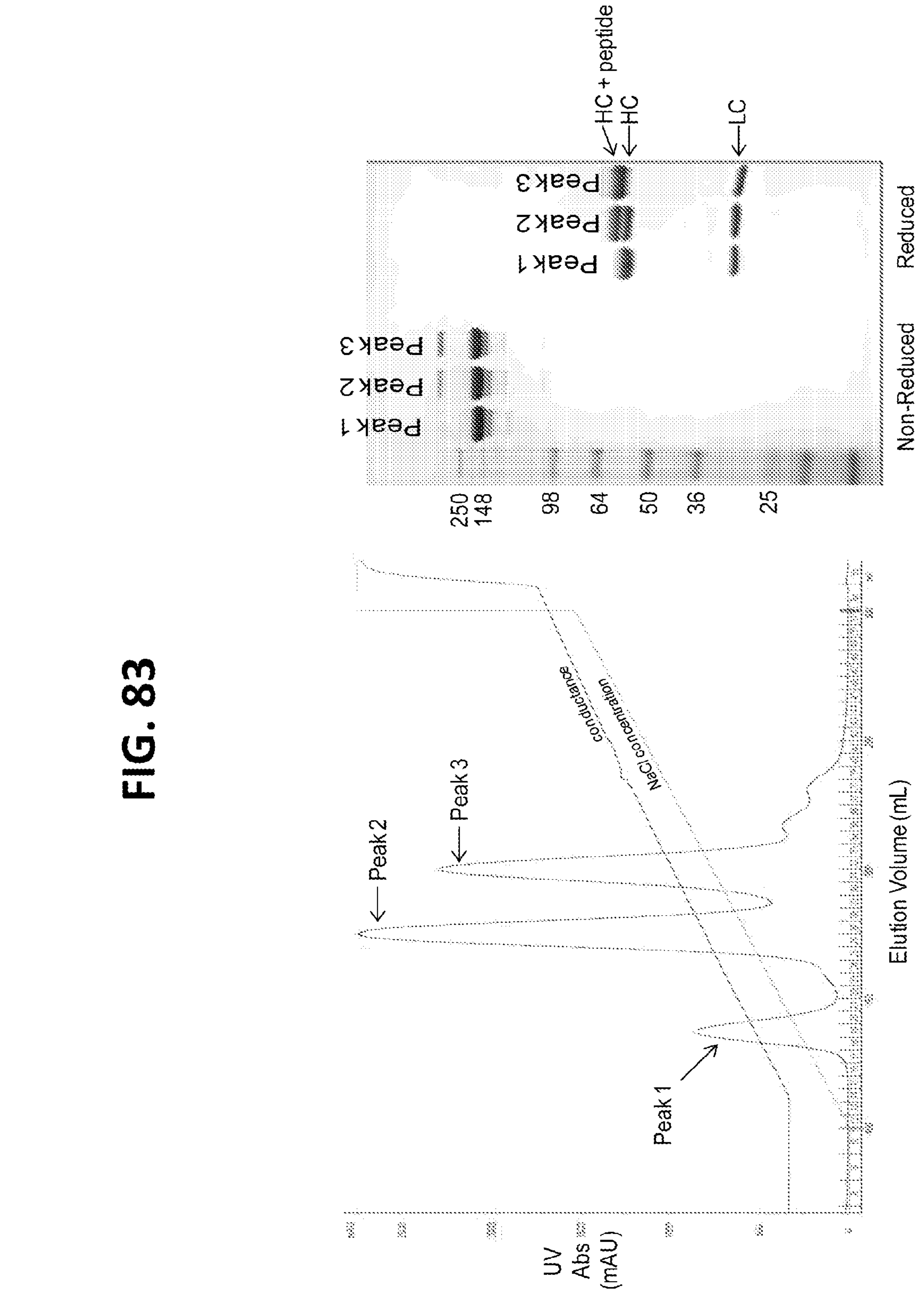

FIG. 83 shows the results from the purification of the site specific conjugation reaction mixture of peptide-linker construct (SEQ ID NO:1062) with anti-DNP mAb (E273C) hIgG1 (comprising immunoglobulin monomers SEQ ID NO:3087; SEQ ID NO:3088; SEQ ID NO:3087; SEQ ID NO:3088). The left panel shows the cation exchange chromatogram of UV absorbance at 280 nm of the conjugation reaction using a 5-mL HiTrap SP-HP column. The right panel shows the non-reducing SDS-PAGE gel (left) of the peaks from the cation exchange chromatogram indicating that the internal disulfide bonds of the antibody-peptide conjugates are intact and the reducing SDS-PAGE gel (right) of the peaks from the cation exchange chromatogram. Peak 1 shows the heavy chain (HC) of the non-reacted antibody. Peak 2 shows approximately 50% of the HC shifted indicating a monovalent antibody-GpTx-1 peptide analog conjugate. Peak 3 shows nearly 100% HC shifted indicating bivalent antibody-GpTx-1 peptide analog conjugate.

Figure 84:
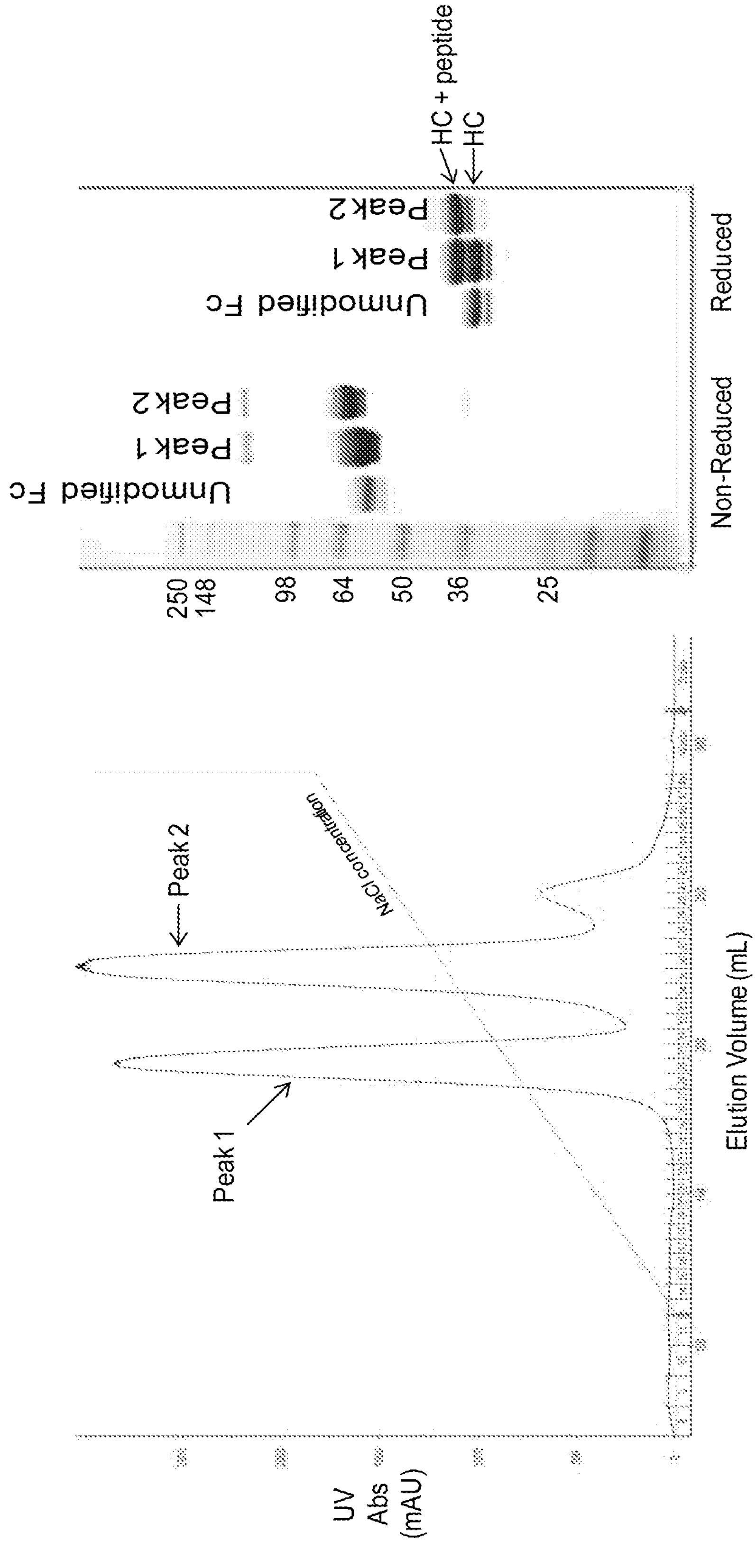

FIG. 84 shows the results from the purification of the site specific conjugation reaction mixture of peptide-linker construct (SEQ ID NO:1062) with anti-DNP mAb (E273C) hIgG1 Fc domain (homodimer of SEQ ID NO:3089). The left panel shows the cation exchange chromatogram of UV absorbance at 280 nm of the conjugation reaction using a 5 mL HiTrap SP-HP column. The right panel shows the non-reducing SDS-PAGE gel (left) of the peaks from the cation exchange chromatogram indicating that the internal disulfide bonds of the antibody-peptide conjugates are intact and the reducing SDS-PAGE gel (right) of the peaks from the cation exchange chromatogram. Peak 1 shows approximately 50% of the HC shifted indicating a monovalent antibody-peptide conjugate. Peak 2 shows near 100% HC shifted indicating bivalent antibody-peptide conjugate.

Figure 85:
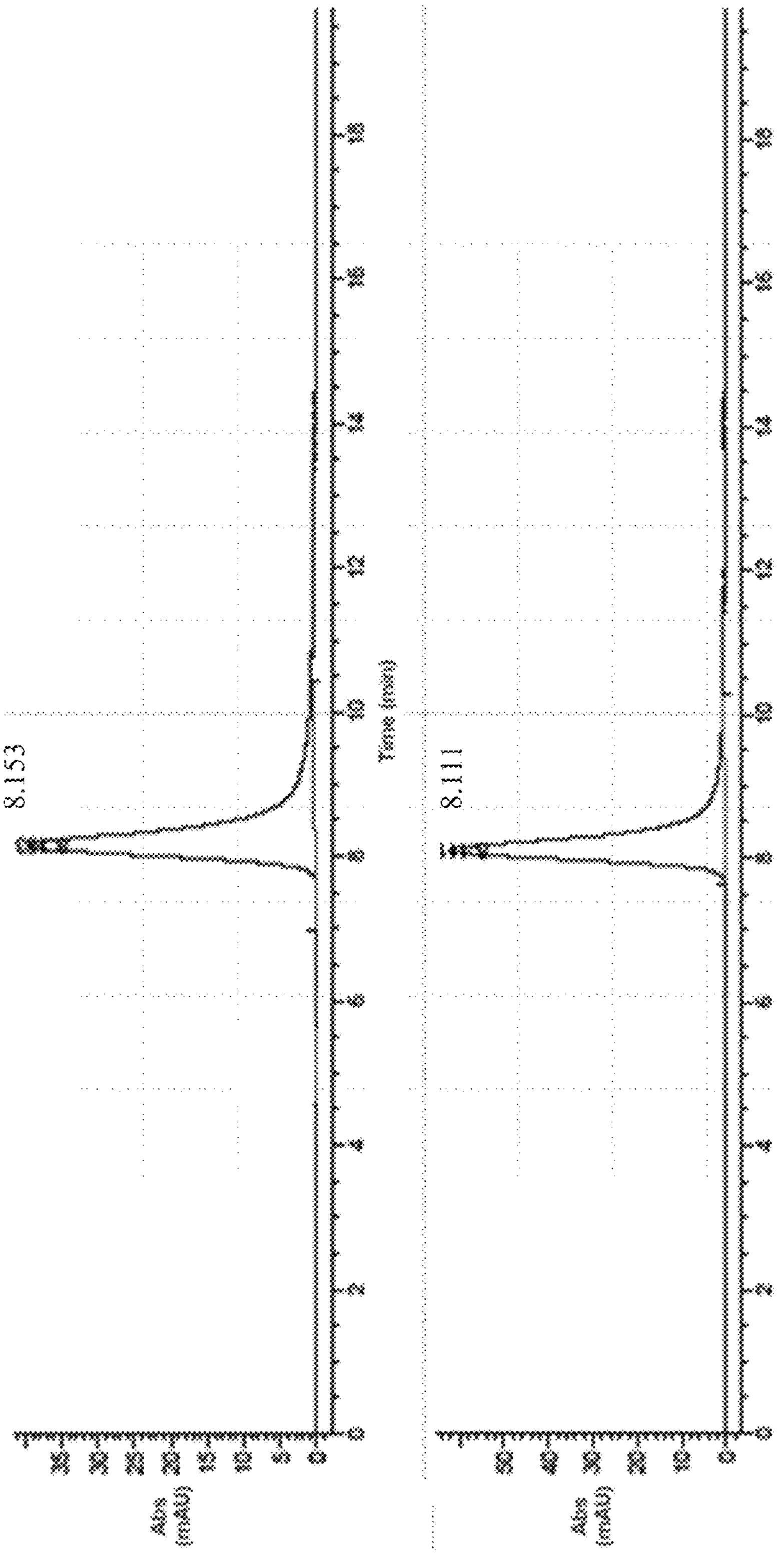

FIG. 85 shows the analytical size exclusion chromatogram of UV absorbance at 280 nm for the (top panel) unmodified anti-DNP mAb (E273C) hIgG1 (comprising SEQ ID NO:3087; SEQ ID NO:3088; SEQ ID NO:3087; SEQ ID NO:3088) and the (bottom panel) bivalent antibody-GpTx-1 peptide analog conjugate (Immunoglobulin-peptide Conjugate 2) run on a Tosoh Bioscience Super SW3000, 4 μM, 250 A, 4.6 mm×30 cm column in 100 mM sodium phosphate, 250 mM NaCl, pH 6.8 with isocratic elution of 0.35 mL/min for 20 min. The chromatogram indicates no aggregation in the peptide conjugate sample.

Figure 86:
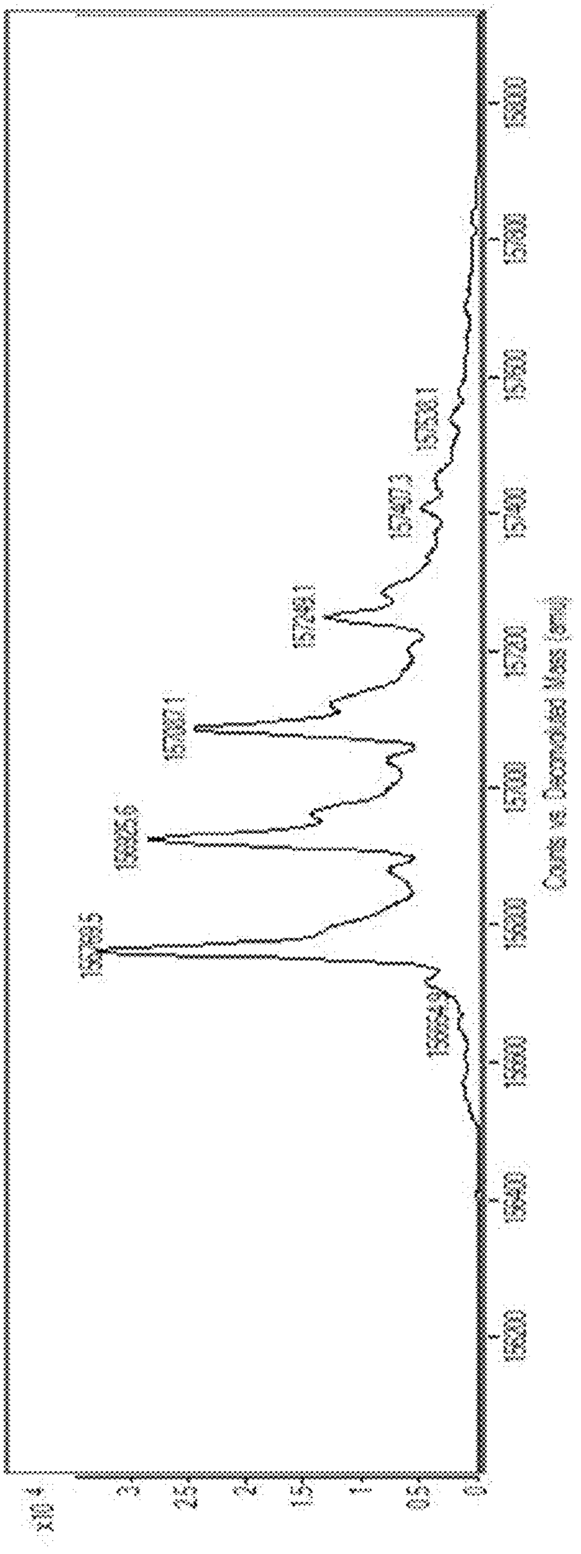

FIG. 86 shows the results from the deconvoluted LC-MS TOF of the bivalent peptide conjugate of peptide-linker construct (SEQ ID NO:1062) with anti-DNP mAb (E273C) hIgG1 (comprising immunoglobulin monomers SEQ ID NO:3087; SEQ ID NO:3088; SEQ ID NO:3087; SEQ ID NO:3088), which is Immunoglobulin-peptide Conjugate 2. The presence of multiple peaks indicates different glycosylation isoforms.

Figure 87:
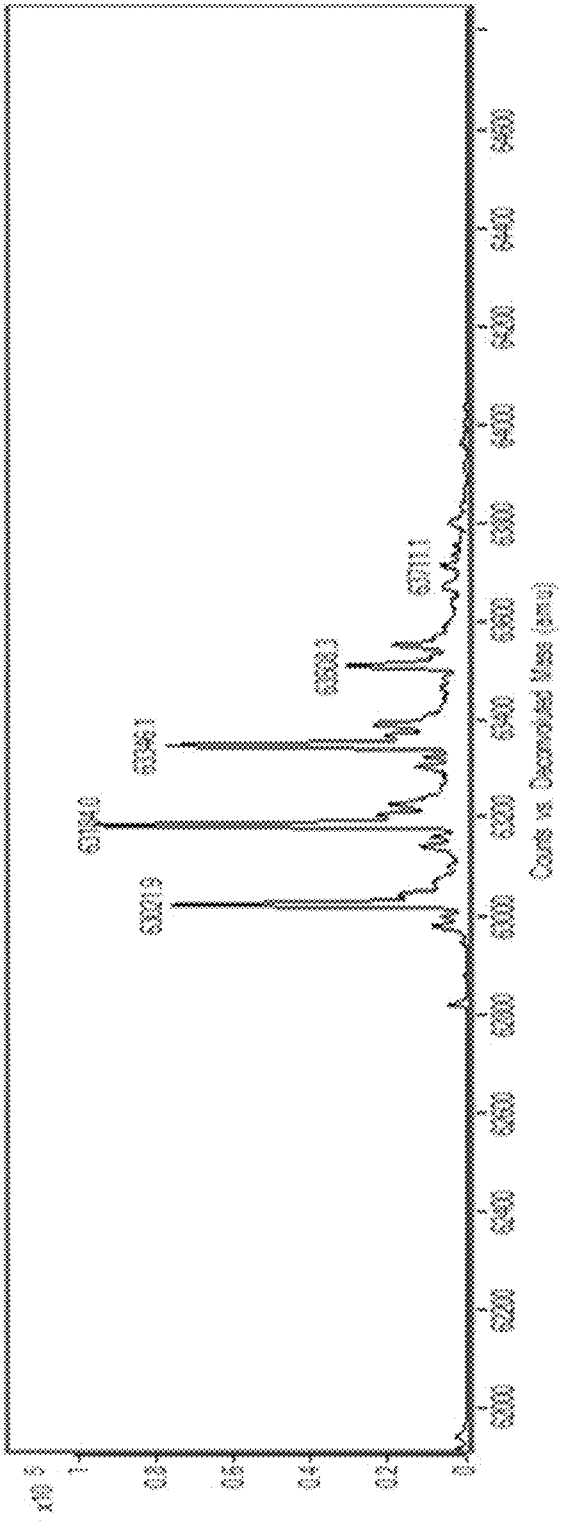

FIG. 87 shows the results from the deconvoluted LC-MS TOF of the bivalent peptide conjugate of peptide-linker construct (SEQ ID NO:1062) with anti-DNP mAb (E52C) hIgG1 Fc domain (homodimer of SEQ ID NO:3089), which is Fc-peptide Conjugate 2. The presence of multiple peaks indicates different glycosylation isoforms.

Figure 88:
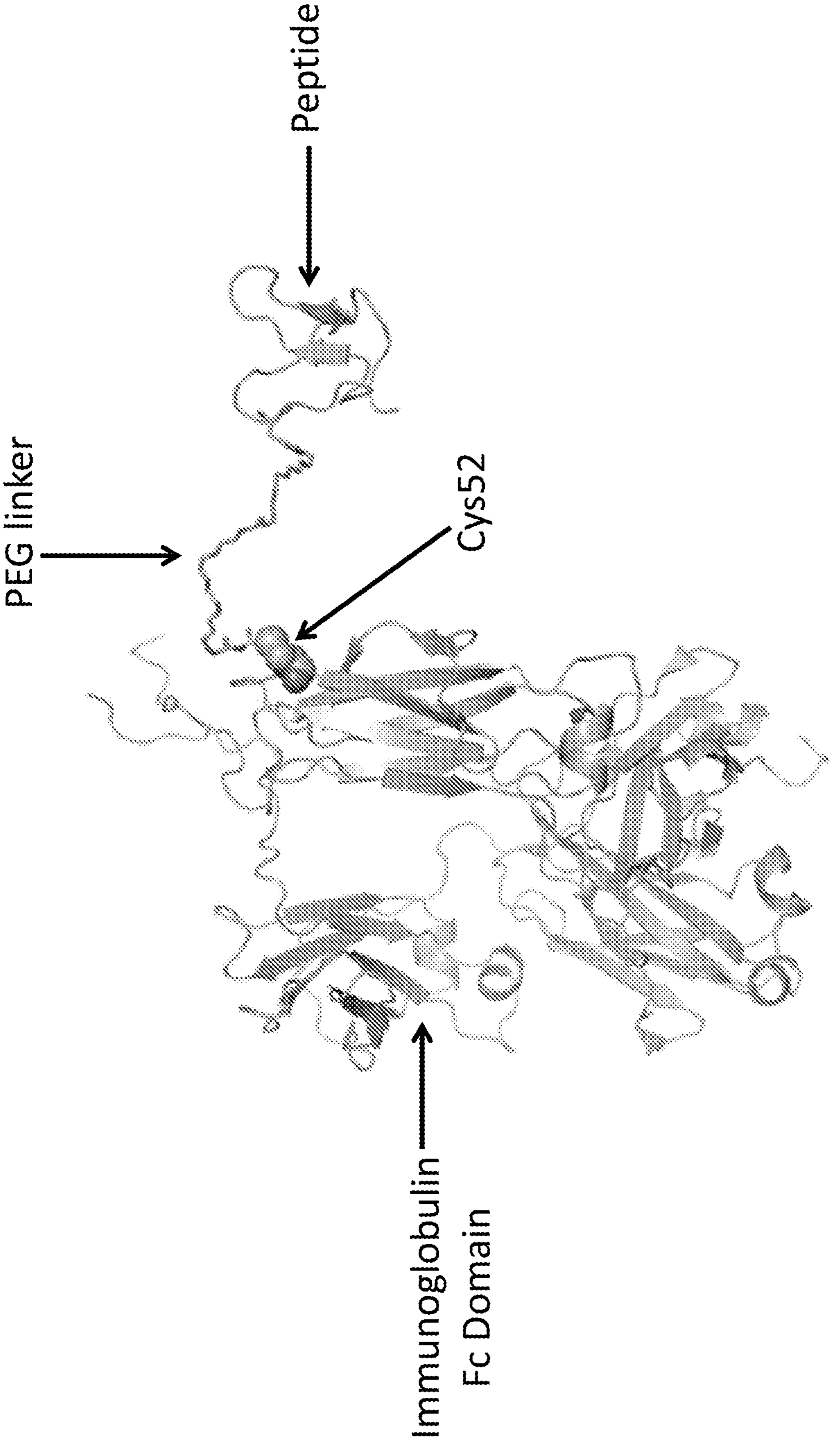

FIG. 88 shows a schematic representation of Fc-peptide Conjugate 1 for illustrative purposes only. A homology model of the immunoglobulin anti-DNP mAb (E52C) hIgG1 Fc domain (homodimer of SEQ ID NO:3089) was constructed from an immunoglobulin crystal structure (1 HZH.pdb) and is depicted as a solid ribbon. Cys52 of SEQ ID 3089, the site of conjugation, is rendered in CPK format. The PEG11 linker is depicted as a solid tube, in an arbitrary conformation in this embodiment, connecting the C52 residue in the immunoglobulin Fc domain to the Atz13 residue in the peptide. A homology model of the peptide (SEQ ID NO:1046) was constructed from the NMR structure of GpTx-1 and is displayed as a solid ribbon and shown in this embodiment in an arbitrary relative orientation to the immunoglobulin Fc domain.

Figure 89:
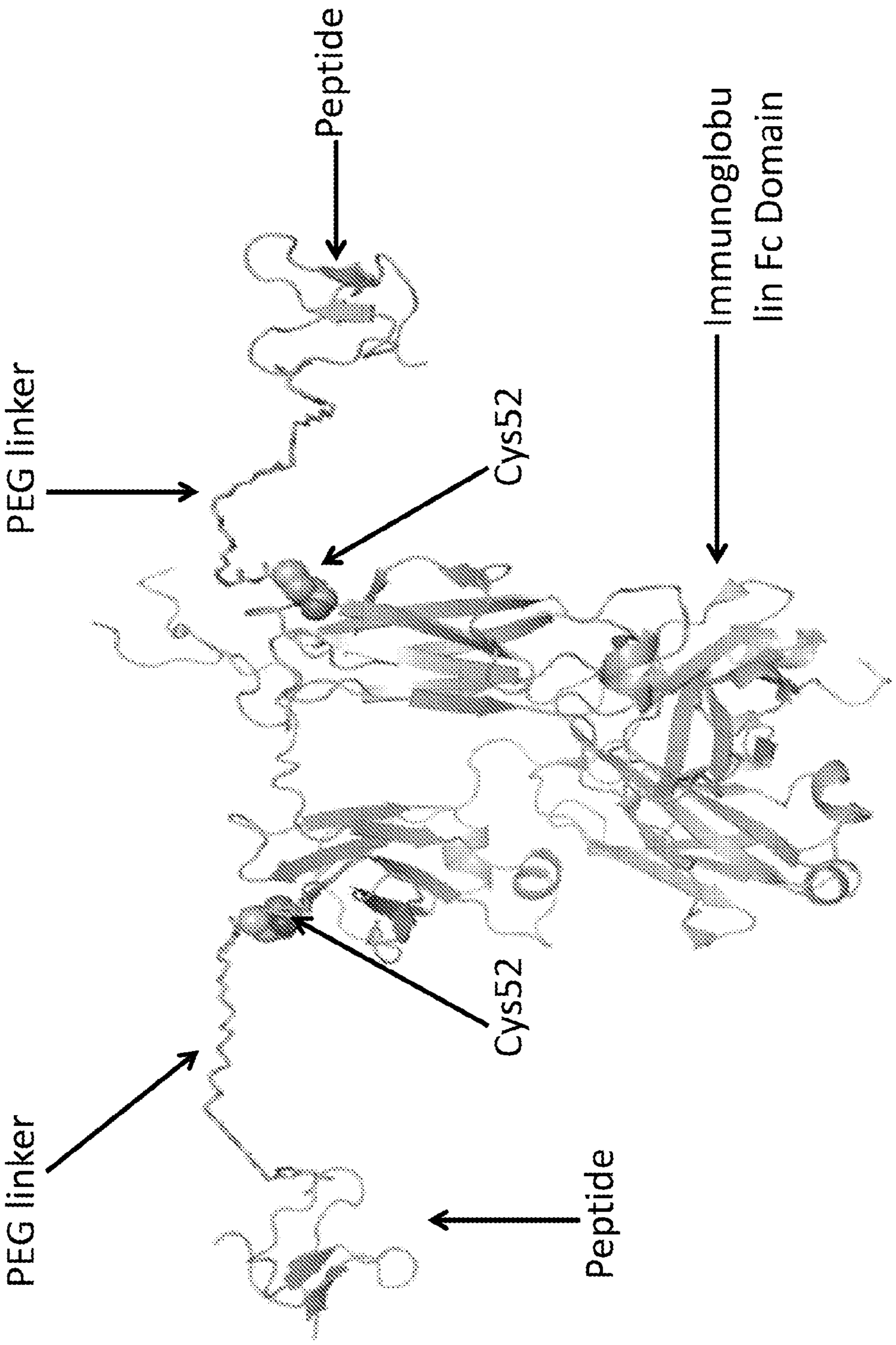

FIG. 89 shows a schematic representation of Fc-peptide Conjugate 2 for illustrative purposes only. A homology model of the anti-DNP mAb (E52C) hIgG1 Fc domain (homodimer of SEQ ID NO:3089) was constructed from an immunoglobulin crystal structure (1 HZH.pdb) and is depicted as a solid ribbon. Cys52 residues of both Fc domain monomers (SEQ ID 3089), were the sites of conjugation, and are rendered in CPK format. The PEG11 linkers are depicted as solid tubes in this embodiment in an arbitrary conformation connecting the C52 residues in the immunoglobulin Fc domain to the Atz13 residues in the peptides. Homology models of the peptide (SEQ ID NO:1046) were constructed from the NMR structure of GpTx-1 and are displayed as a solid ribbon and shown in arbitrary relative orientations to the immunoglobulin Fc domain. Two peptides are shown to reflect the bivalent nature of Fc-peptide Conjugate 2.

Figure 90:
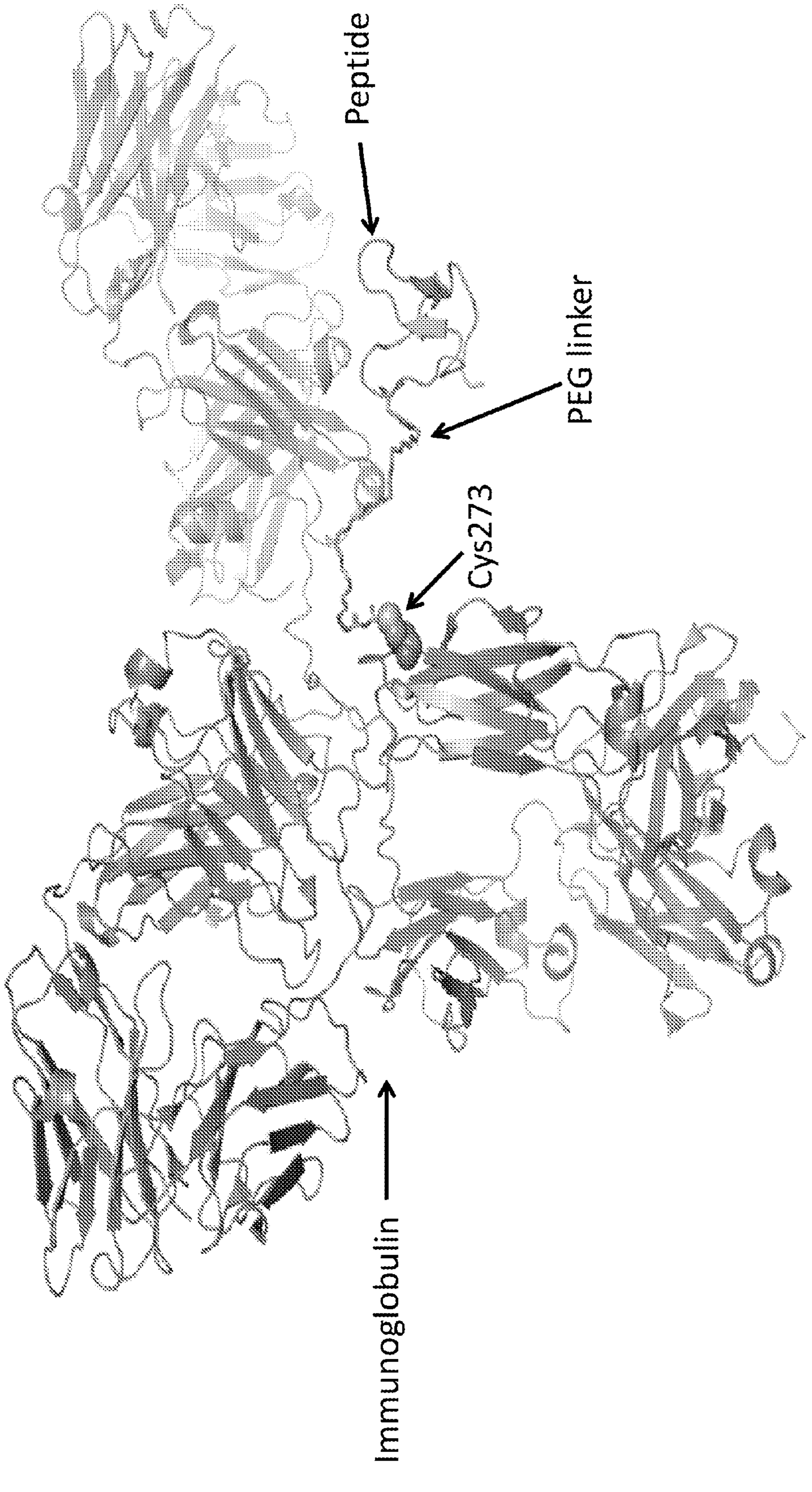

FIG. 90 shows a schematic representation of Immunoglobulin-peptide Conjugate 1 for illustrative purposes only. A homology model of the anti-DNP mAb (E273C) hIgG1 (comprising immunoglobulin monomers SEQ ID NO:3087; SEQ ID NO:3088; SEQ ID NO:3087; SEQ ID NO:3088) was constructed from an immunoglobulin crystal structure (1 HZH.pdb) and is depicted as a solid ribbon. Cys273, the site of conjugation, is rendered in CPK format. In this embodiment, the PEG11 linker is depicted as a solid tube in an arbitrary conformation connecting the C273 residue in the immunoglobulin to the Atz13 residue in the peptide. A homology model of the peptide (SEQ ID NO:1046) was constructed from the NMR structure of GpTx-1 and is displayed as a solid ribbon and shown in an arbitrary relative orientation to the immunoglobulin in this embodiment.

Figure 91:
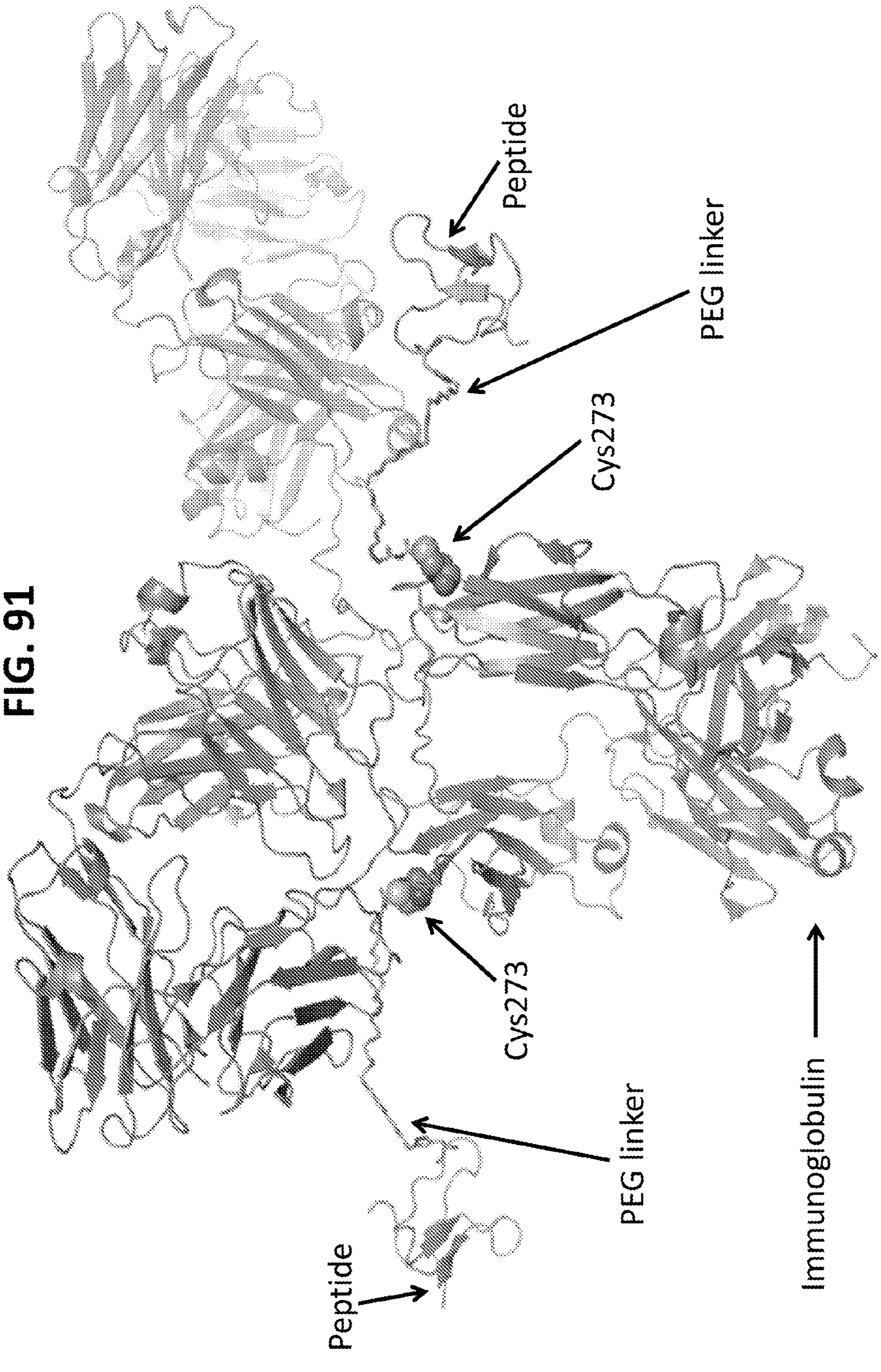

FIG. 91 shows a schematic representation of Immunoglobulin-peptide Conjugate 2 for illustrative purposes only. A homology model of the anti-DNP mAb (E273C) hIgG1 (comprising immunoglobulin monomers SEQ ID NO:3087; SEQ ID NO:3088; SEQ ID NO:3087; SEQ ID NO:3088) was constructed from an immunoglobulin crystal structure (1 HZH.pdb) and is depicted as a solid ribbon. Both Cys273 residues, the sites of conjugation, are rendered in CPK format. In this embodiment, the PEG11 linkers are depicted as solid tubes in an arbitrary conformation connecting the C273 residues in the immunoglobulin to the Atz13 residues in the peptides. Homology models of the peptide (SEQ ID NO:1046) were constructed from the NMR structure of GpTx-1 and are displayed as a solid ribbon and shown in arbitrary relative orientations to the immunoglobulin in this embodiment. Two peptides are shown to reflect the bivalent nature of Immunoglobulin-peptide Conjugate 2.

Figure 92:
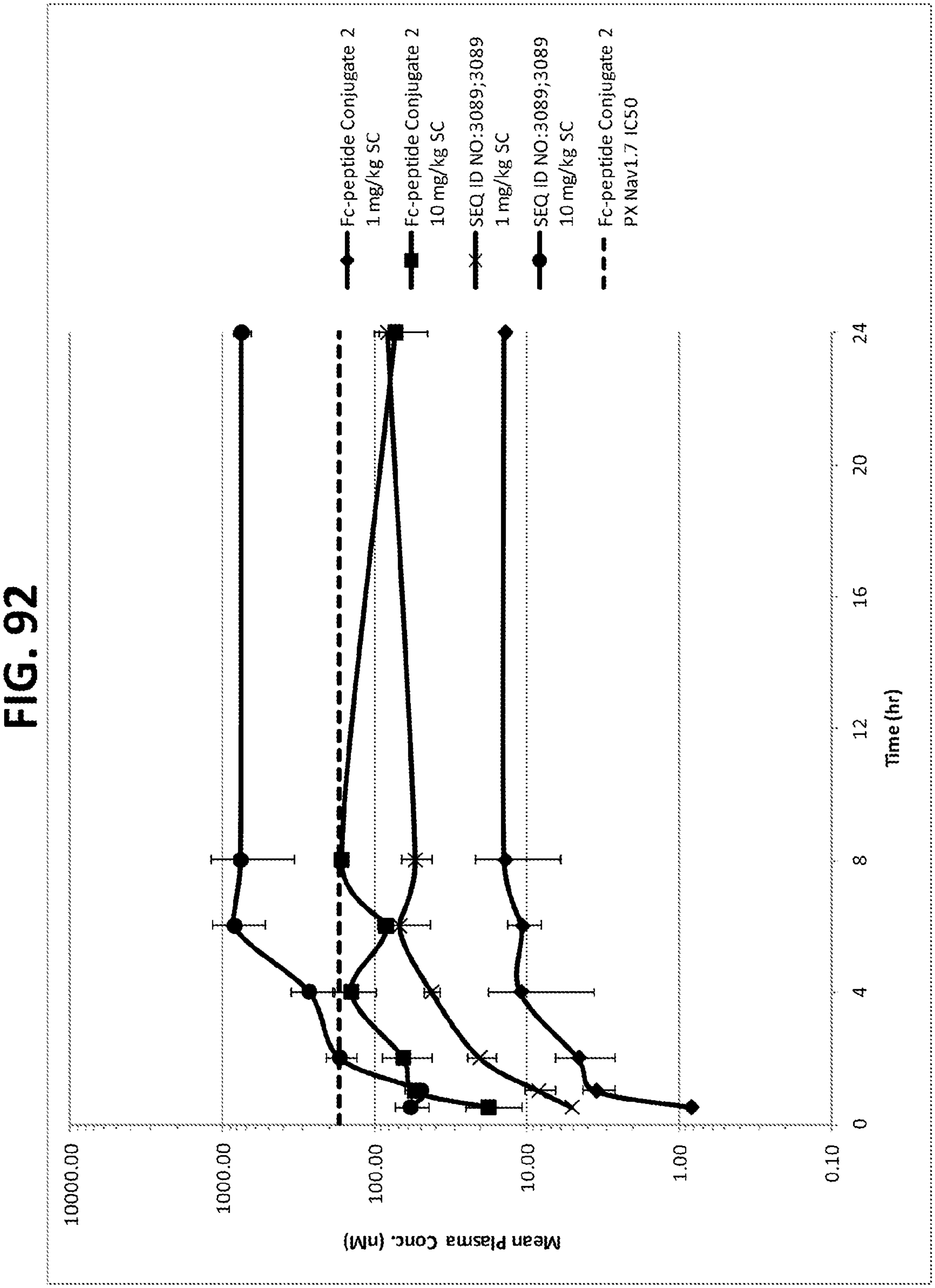

FIG. 92 shows the mean plasma concentration-time profiles of GpTx-1 peptide analog-Fc conjugate (Fc-Peptide Conjugate 2) and control Fc (homodimer of SEQ ID NO:3089) following a 1 and 10 mg/kg s.c. dose to mice (n=3).

Figure 93:
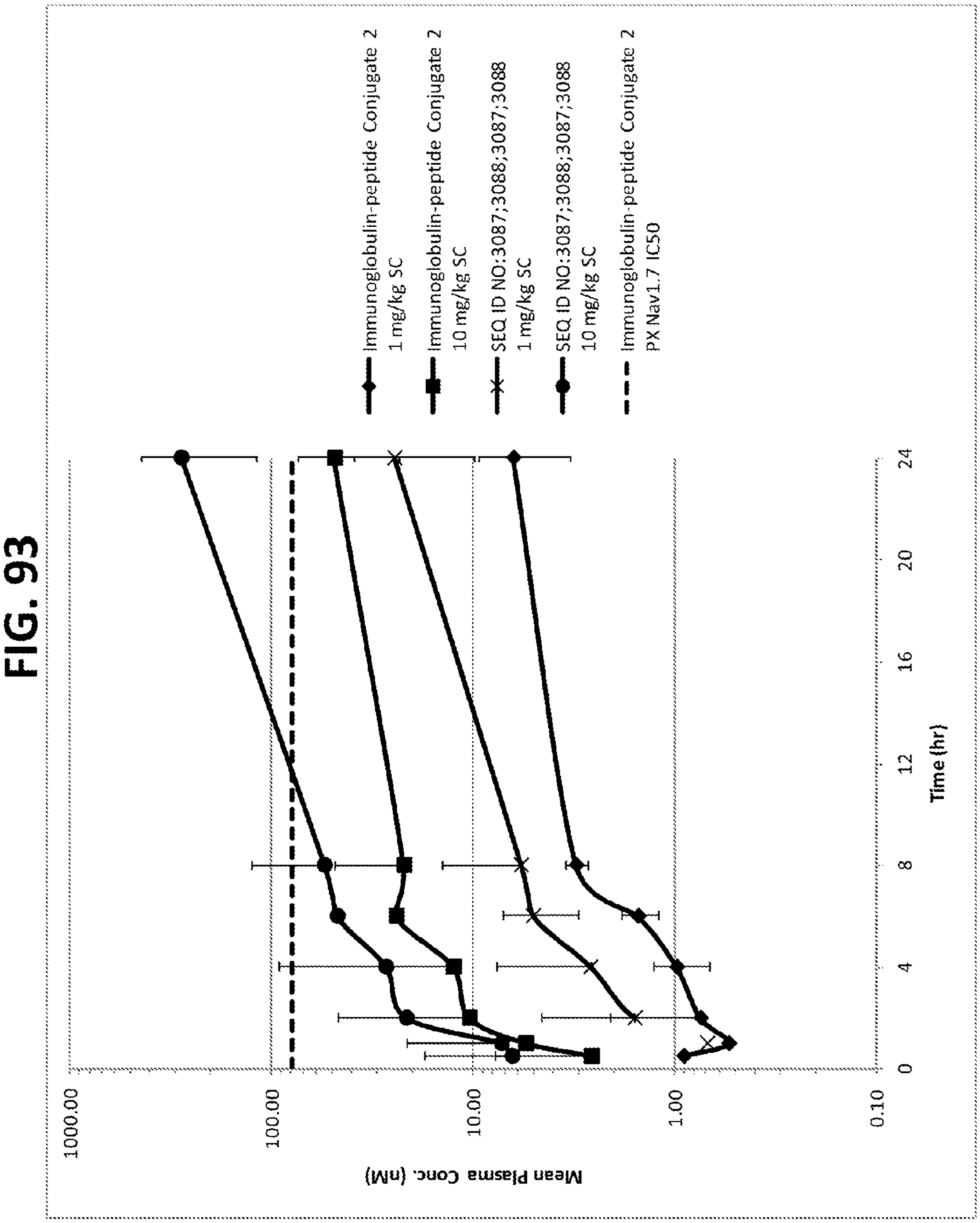

FIG. 93 shows the mean plasma concentration-time profiles of peptide-IgG conjugate (Immunoglobulin-Peptide Conjugate 2) and control IgG (hIgG1 mAb comprising SEQ ID NO:3087; SEQ ID NO:3088; SEQ ID NO:3087; SEQ ID NO:3088) following a 1 and 10 mg/kg s.c. dose to mice (n=3).

Figure 94:
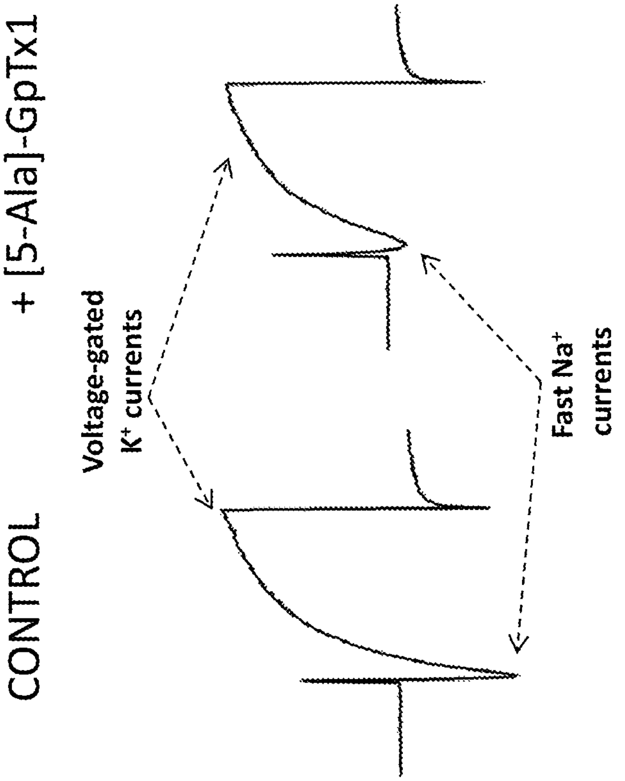

FIG. 94 shows the effects of peptide [Ala5]GpTx-1 (SEQ ID NO:22) at 500 nM on fast sodium current and voltage-gated potassium currents. Traces are voltage-clamp recordings from a neuron enzymatically isolated from rat dorsal root ganglia. Inward sodium and outward potassium currents combined were evoked simultaneously by a 20 ms step to 0 mV from a holding voltage of −90 mV. Trace at right was taken approximately 160 seconds after addition of 500 nM peptide. [Ala5]GpTx-1 (SEQ ID NO:22) at 500 nM blocked fast sodium current but not voltage-gated potassium currents.

Figure 95:
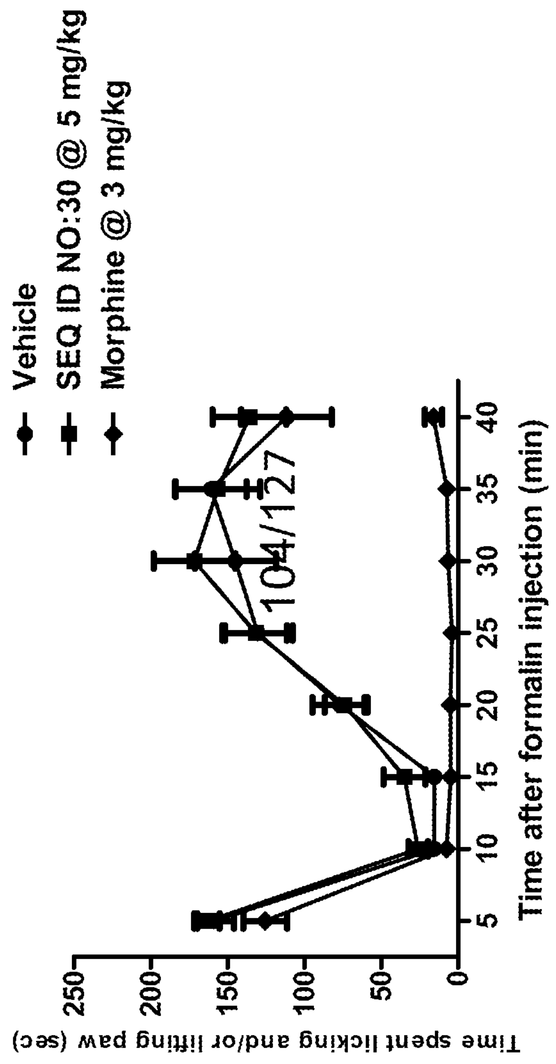

FIG. 95 shows the timecourse of the effect of [Glu29]GpTx-1(1-34) (SEQ ID NO:30) in the formalin pain model in male CD-1 mice with a 1-hour pre-treatment dose of 5 mg/kg s.c. The 5 mg/kg peptide dose and the 3 mg/kg s.c. dose of the positive control morphine (30 minutes pretreatment) had no significant effect in the first phase (0-5 minutes post formalin injection). The 5 mg/kg s.c. dose of [Glu29]GpTx-1(1-34) (SEQ ID NO:30) did not demonstrate a significant reduction of the time spent lifting/licking in the second phase of the study (5-40 minutes post formalin injection), but the morphine positive control did significantly reduce the time spent lifting/licking in the second phase. Terminal exposure (peptide plasma concentration at 45 min post formalin injection) was 0.502±0.271 μM for the 5 mg/kg peptide dose.

Figure 96:
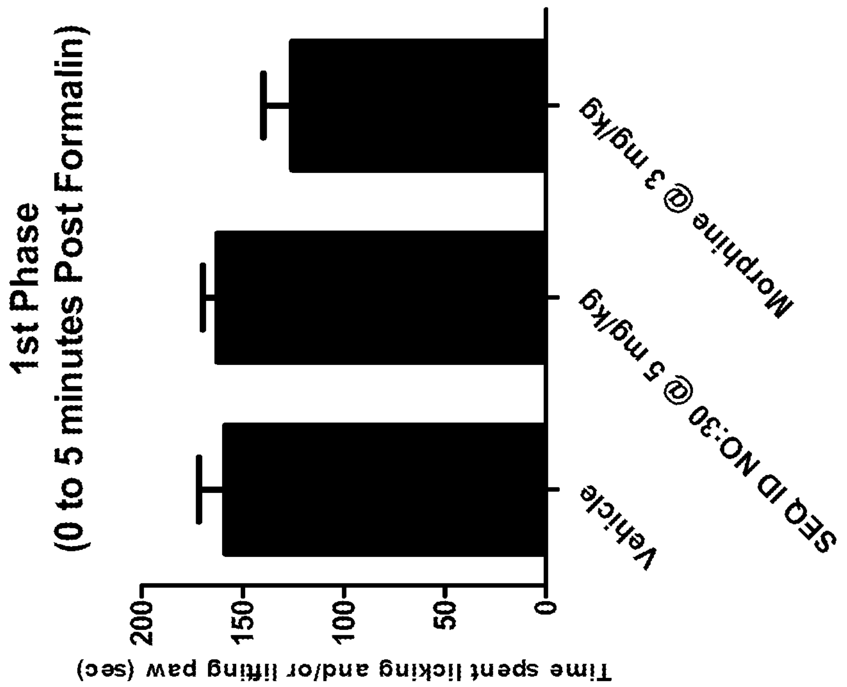

FIG. 96 shows the effect of [Glu29]GpTx-1(1-34) (SEQ ID NO:30) in the first phase of the formalin pain model in male CD-1 mice with a 1-hour pre-treatment dose of 5 mg/kg s.c. The 5 mg/kg peptide dose and the 3 mg/kg s.c. dose of morphine had no effect in the first phase (0-5 minutes post formalin injection).

Figure 97:
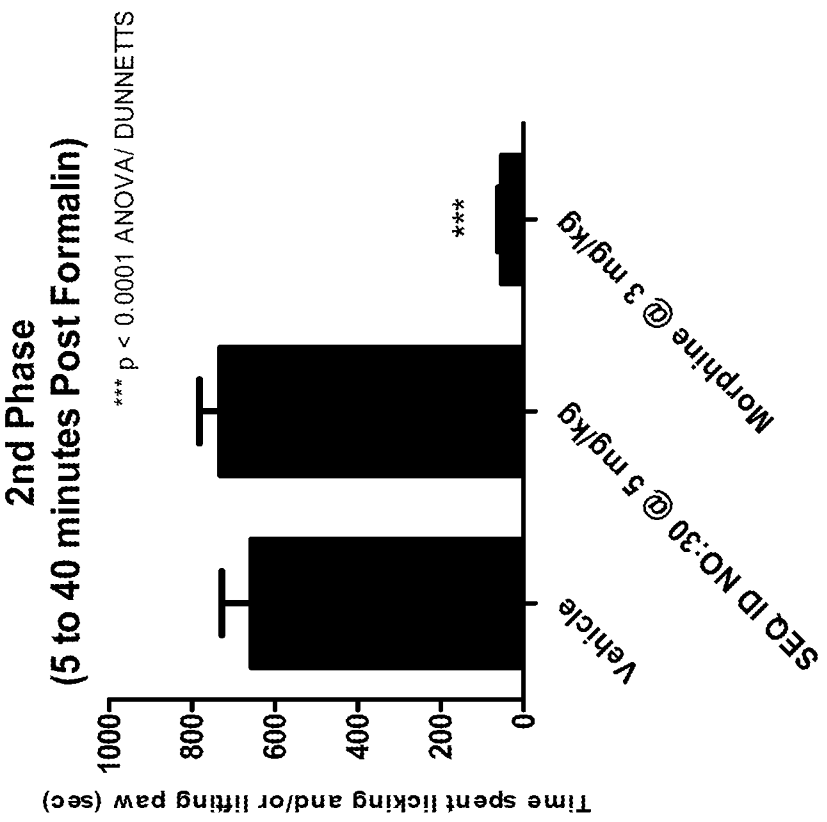

FIG. 97 shows the effect of [Glu29]GpTx-1(1-34) (SEQ ID NO:30) in the second phase of the formalin pain model (5-40 minutes post formalin injection) in male CD-1 mice with a 1 hour pre-treatment dose of 5 mg/kg s.c. The 5 mg/kg s.c. dose of peptide did not demonstrate a significant reduction of the time spent lifting/licking in the second phase of the study relative to the vehicle control. The morphine positive control did significantly reduce the time spent lifting/licking in the second phase.

Figure 98:
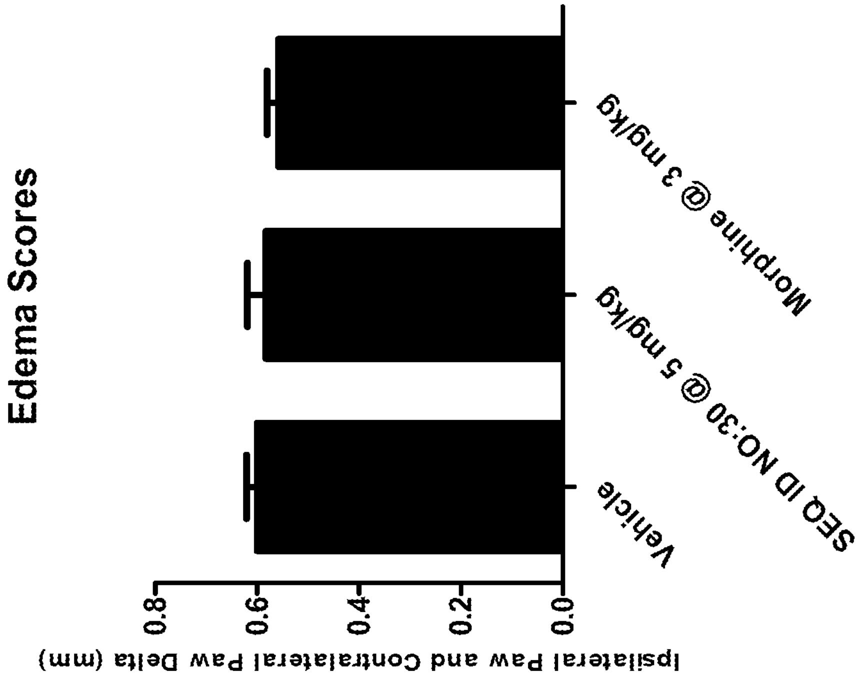

FIG. 98 shows the effect of [Glu29]GpTx-1(1-34) (SEQ ID NO:30) on paw edema in the formalin pain model in male CD-1 mice with a 1-hour pre-treatment dose 5 mg/kg s.c. Neither the peptide nor the morphine control significantly reduced the paw edema caused by formalin injection relative to the vehicle (PBS).

Figure 99:
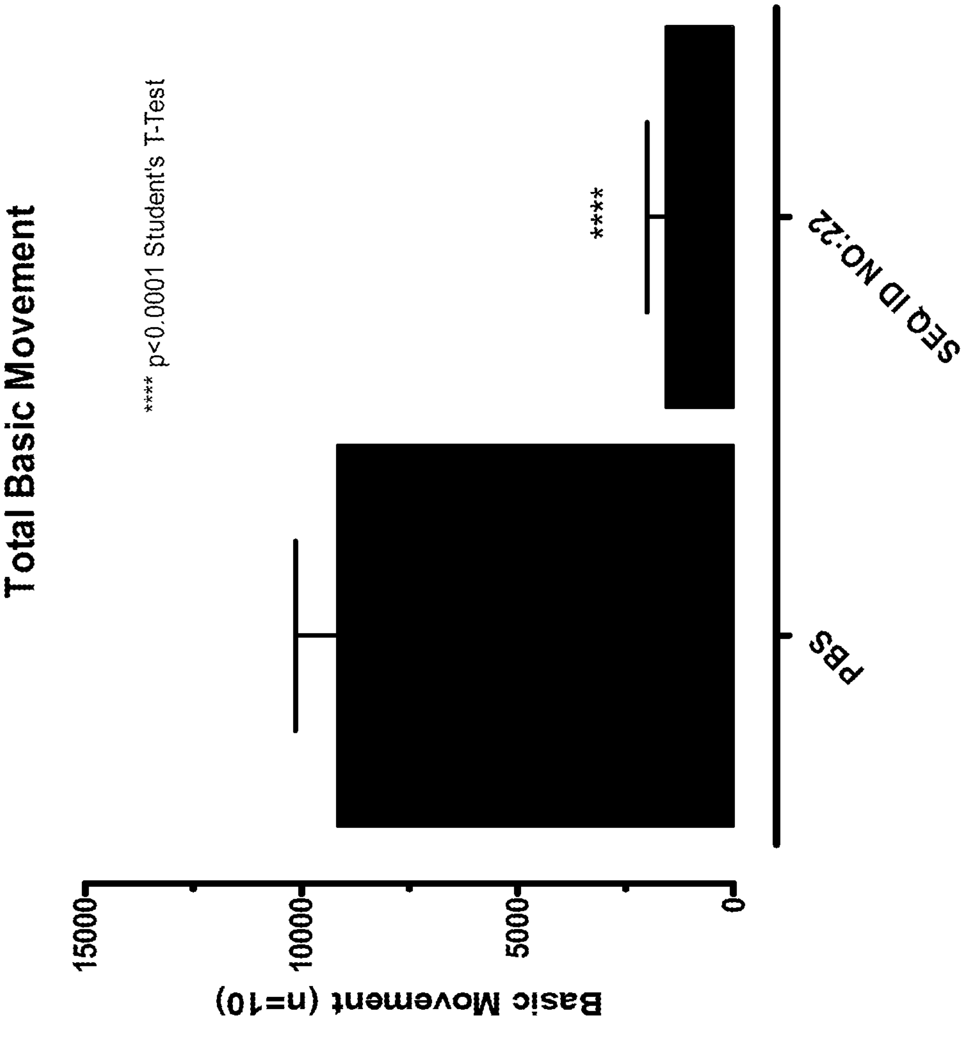

FIG. 99 shows a repeat of the effect of [Ala5]GpTx-1(1-34) (SEQ ID NO:22) at a 5 mg/kg s.c. dose with a 1-hour pre-treatment time on the total basic movement component of locomotor activity in male CD-1 mice. Total basic movement was significantly reduced by the 5 mg/kg peptide dose. Terminal exposure (peptide plasma concentration at 2 h post peptide injection) was 2.1±0.47 μM.

Figure 100:
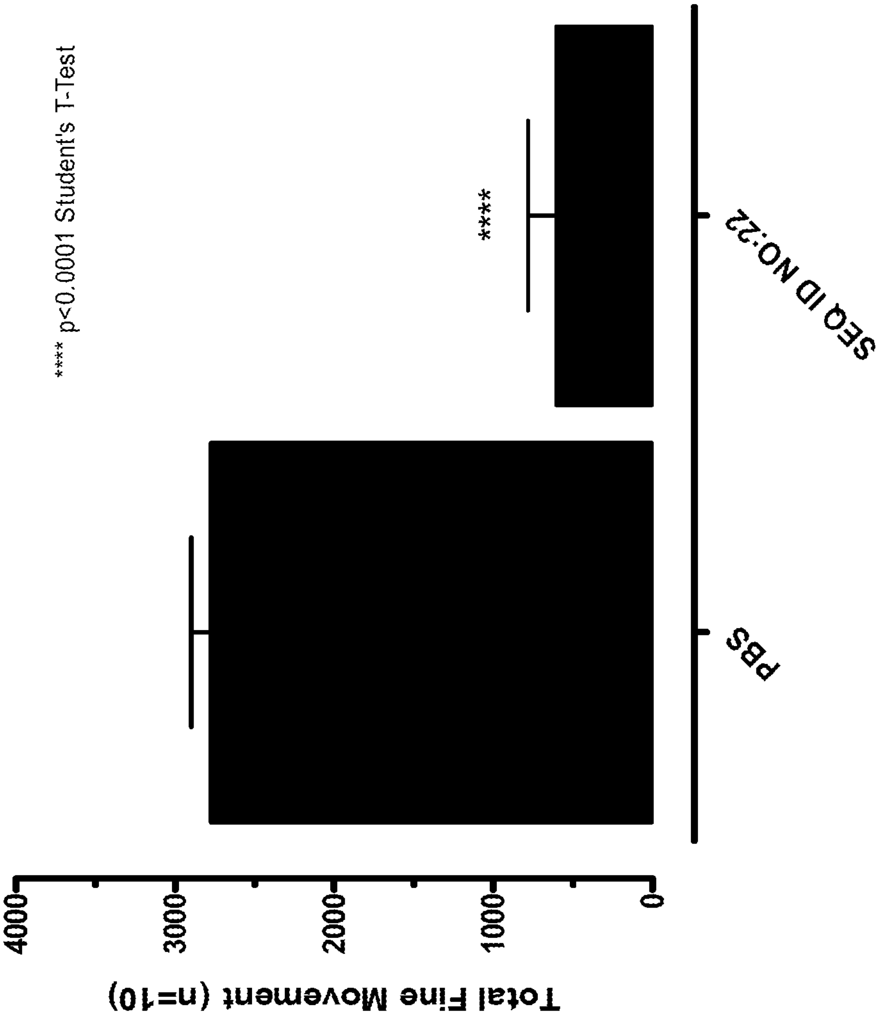

FIG. 100 shows the effect of [Ala5]GpTx-1(1-34) (SEQ ID NO:22) at a 5 mg/kg s.c. dose with a 1-hour pre-treatment time on the fine movement component of locomotor activity in male CD-1 mice. At the 5 mg/kg dose, peptide significantly reduced the total fine movement relative to the vehicle.

Figure 101:
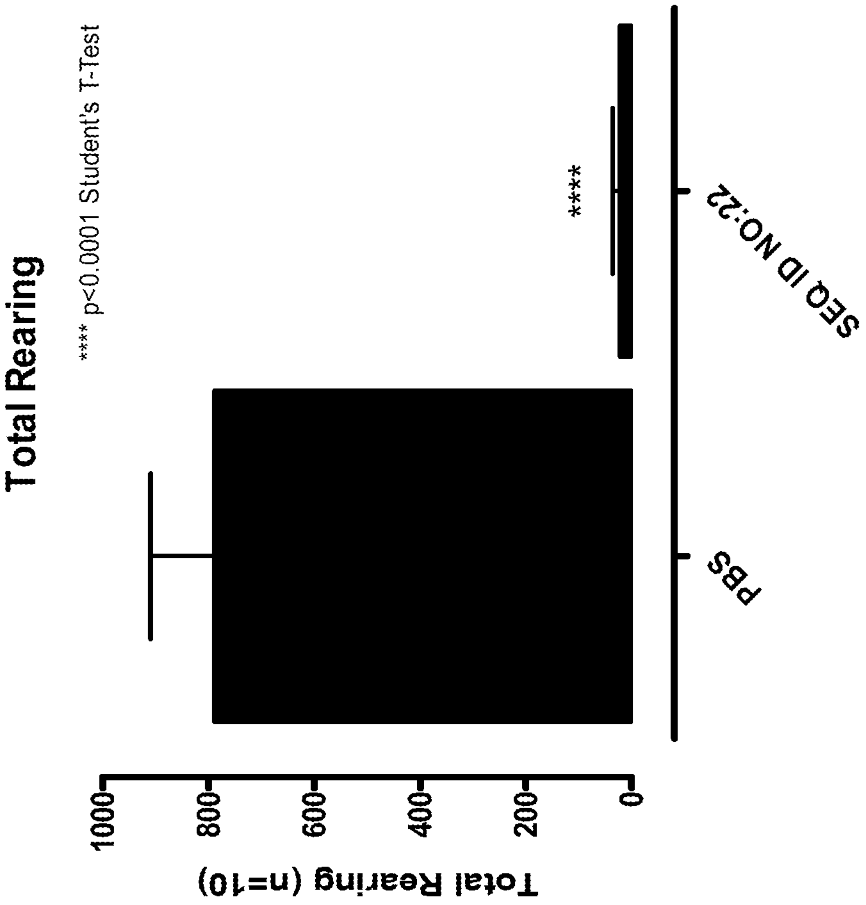

FIG. 101 shows the effect of [Ala5]GpTx-1(1-34) (SEQ ID NO:22) at a 5 mg/kg s.c. dose with a 1-hour pre-treatment time on the total rearing component of locomotor activity in male CD-1 mice. At the 5 mg/kg dose, peptide significantly reduced total rearing relative to the vehicle control.

Figure 102:
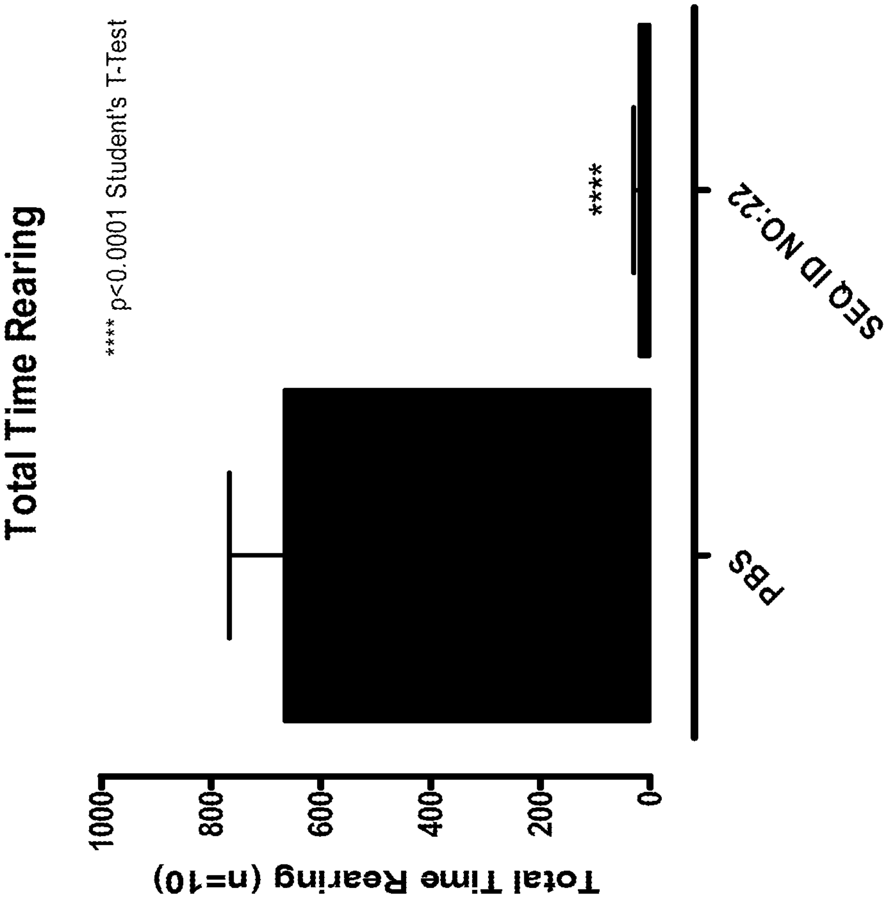

FIG. 102 shows the effect of [Ala5]GpTx-1(1-34) (SEQ ID NO:22) at a 5 mg/kg s.c. dose with a 1-hour pre-treatment time on the total time rearing component of locomotor activity in male CD-1 mice. At the 5 mg/kg dose, peptide significantly reduced the total time rearing relative to the vehicle control.

Figure 103:
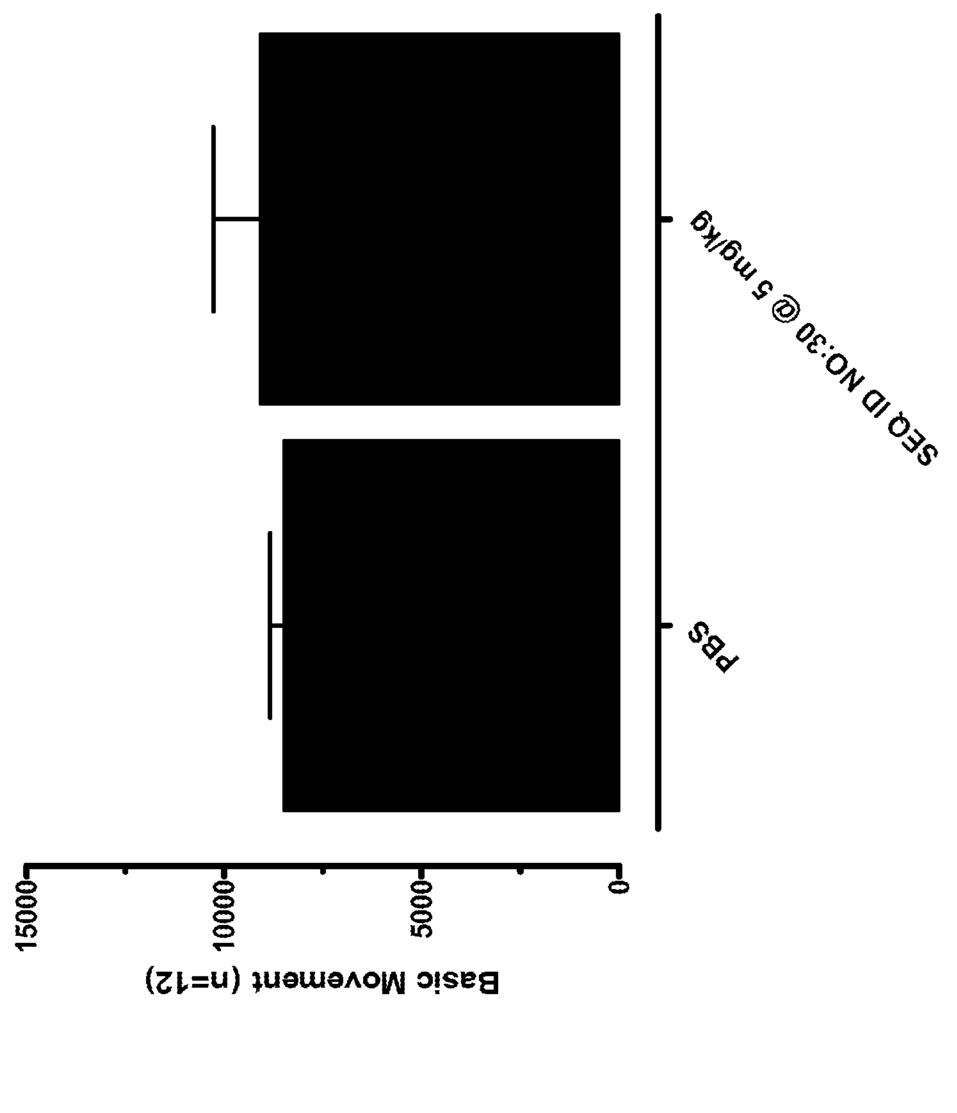

FIG. 103 shows the effect of [Glu29]GpTx-1(1-34) (SEQ ID NO:30) at a 5 mg/kg s.c. dose with a 1-hour pre-treatment time on the total basic movement component of locomotor activity in male CD-1 mice. The peptide dose did not significantly decrease exploratory behavior or total basic movement relative to the vehicle control. Terminal exposure (peptide plasma concentration at 2 h post peptide injection) was 0.771±0.272 μM for the 5 mg/kg s.c. peptide dose.

Figure 104:
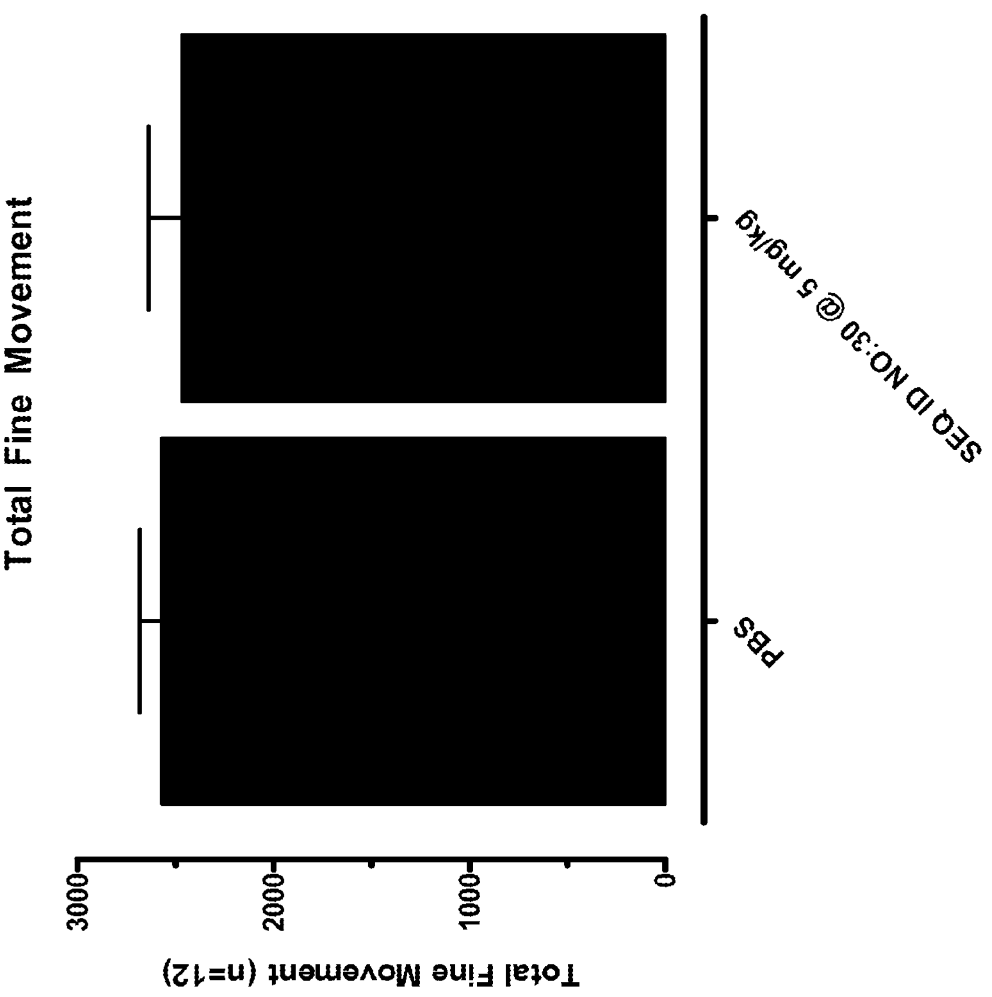

FIG. 104 shows the effect of [Glu29]GpTx-1(1-34) (SEQ ID NO:30) at a 5 mg/kg s.c. dose with a 1-hour pre-treatment time on the fine movement component of locomotor activity in male CD-1 mice. At the 5 mg/kg dose, fine movement was not significantly affected relative to the vehicle control.

Figure 105:
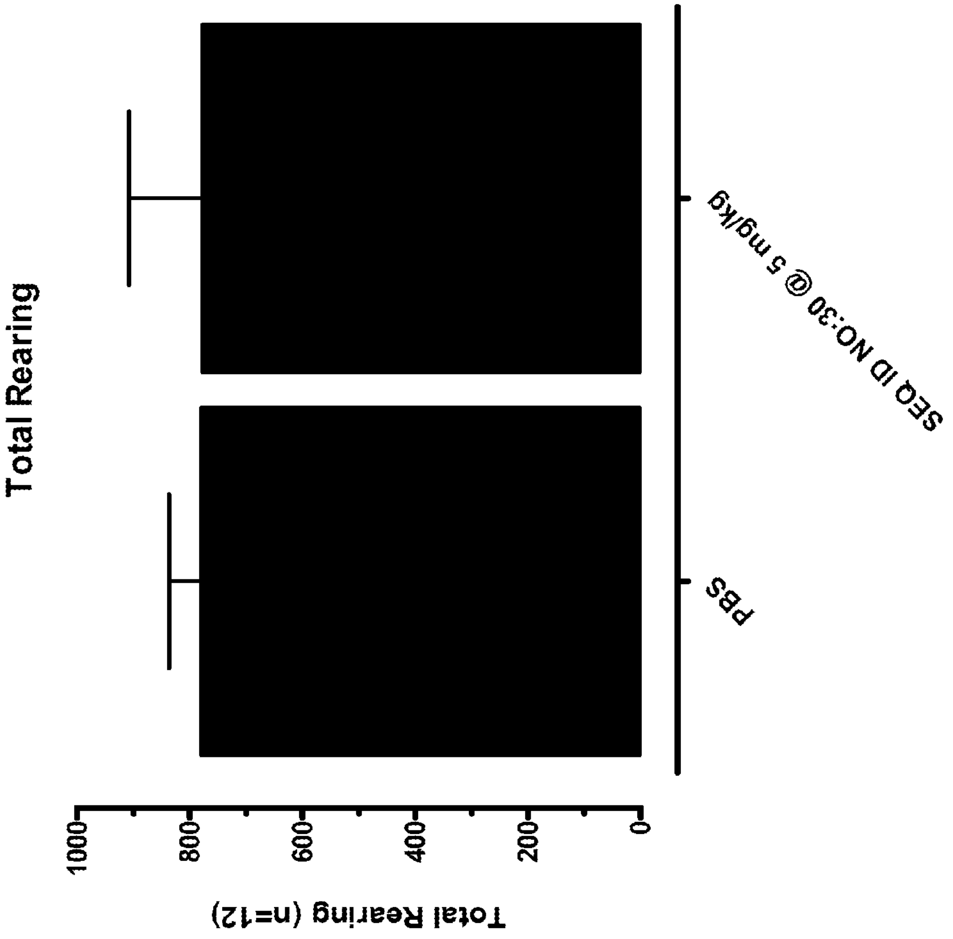

FIG. 105 shows the effect of [Glu29]GpTx-1(1-34) (SEQ ID NO:30) at 5 mg/kg s.c. dose with a 1-hour pre-treatment time on the total rearing component of locomotor activity in male CD-1 mice. The peptide dose did not significantly decrease exploratory behavior or total rearing in relation to the vehicle control.

Figure 106:
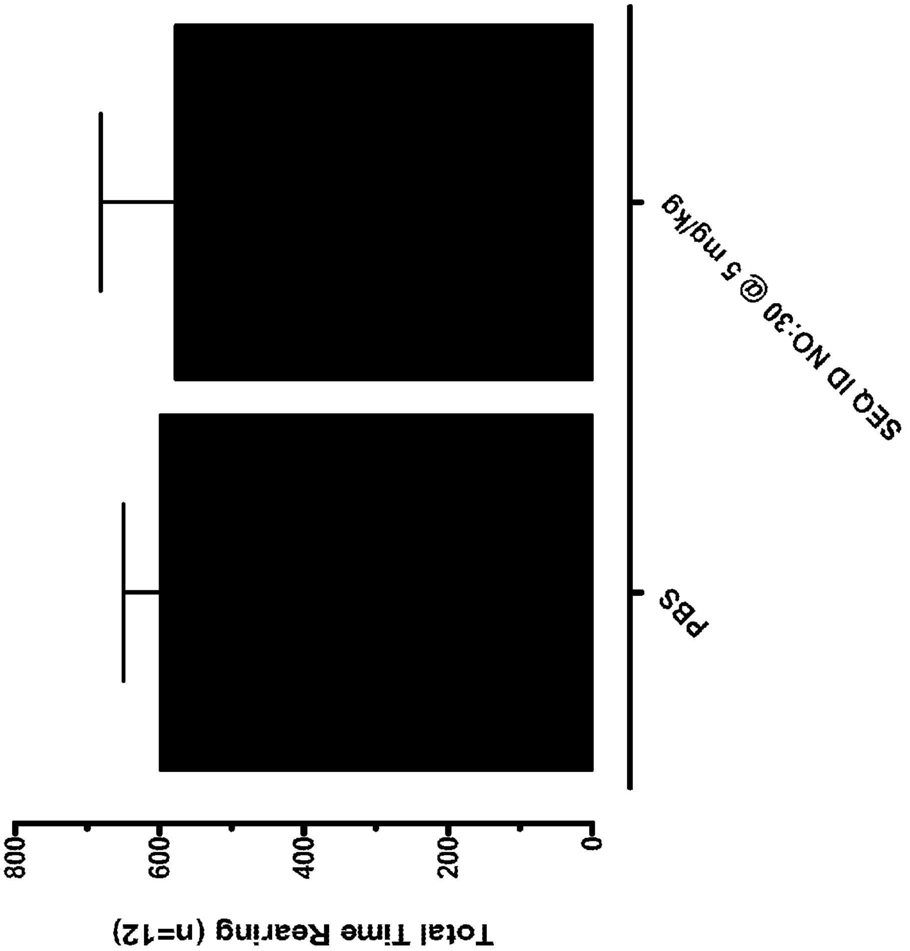

FIG. 106 shows the effect of [Glu29]GpTx-1(1-34) (SEQ ID NO:30) at a 5 mg/kg s.c. dose with a 1-hour pre-treatment time on the total time rearing component of locomotor activity in male CD-1 mice. At the 5 mg/kg dose, total time rearing was not significantly affected relative to the vehicle control.

Figure 107:
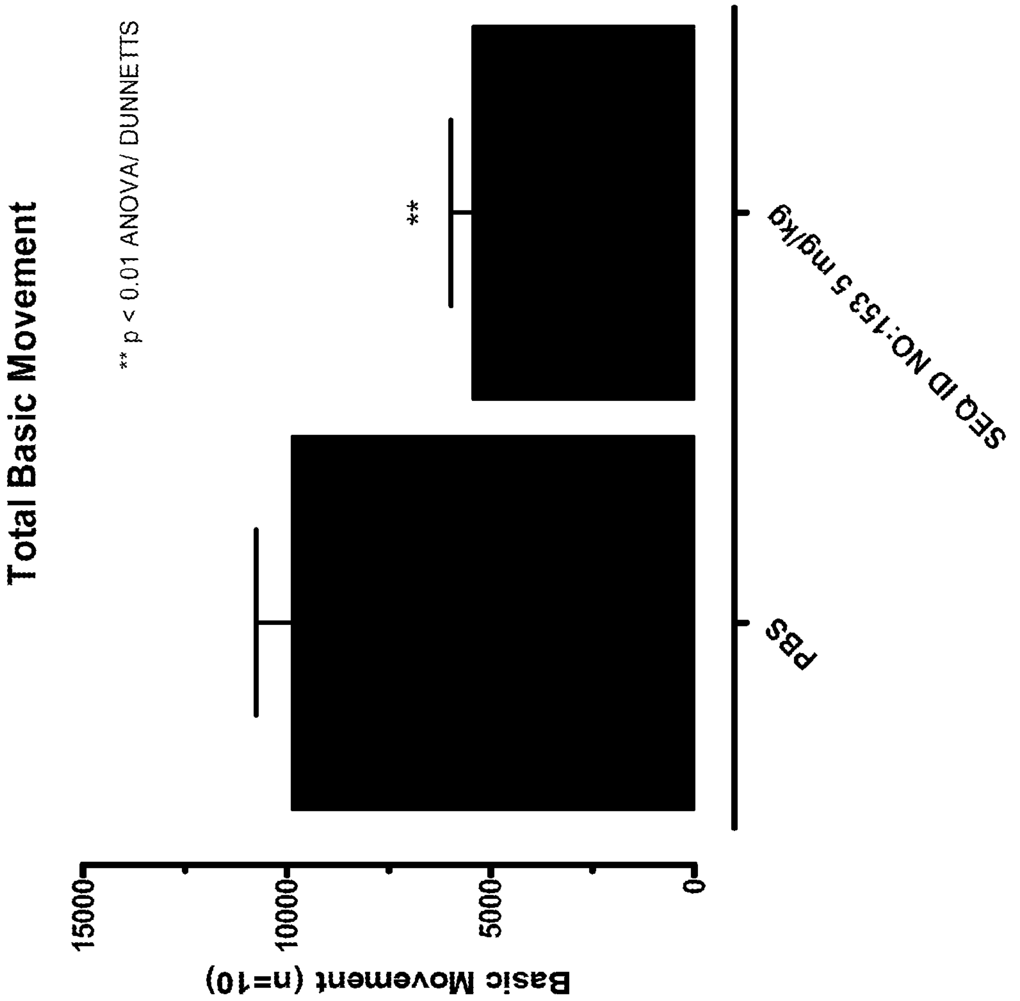

FIG. 107 shows the effect of [Glu28]GpTx-1(1-34) (SEQ ID NO:153) at a 5 mg/kg s.c. dose with a 1-hour pre-treatment time on the total basic movement component of locomotor activity in male CD-1 mice. Total basic movement was significantly reduced by the 5 mg/kg peptide dose. Terminal exposure (peptide plasma concentration at 2 h post peptide injection) was 1.28±0.403 μM.

Figure 108:
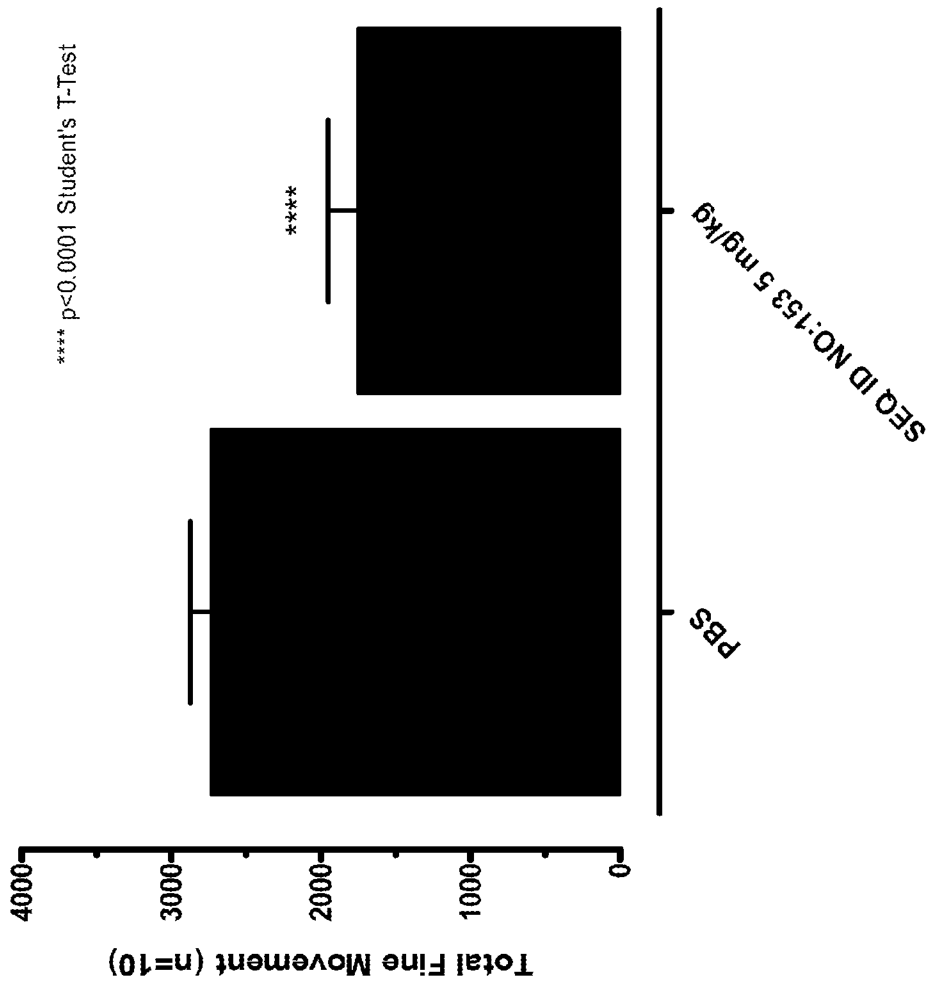

FIG. 108 shows the effect of [Glu28]GpTx-1(1-34) (SEQ ID NO:153) at a 5 mg/kg s.c. dose with a 1-hour pre-treatment time on the fine movement component of locomotor activity in male CD-1 mice. At the 5 mg/kg dose, peptide significantly reduced the total fine movement relative to the vehicle.

Figure 109:
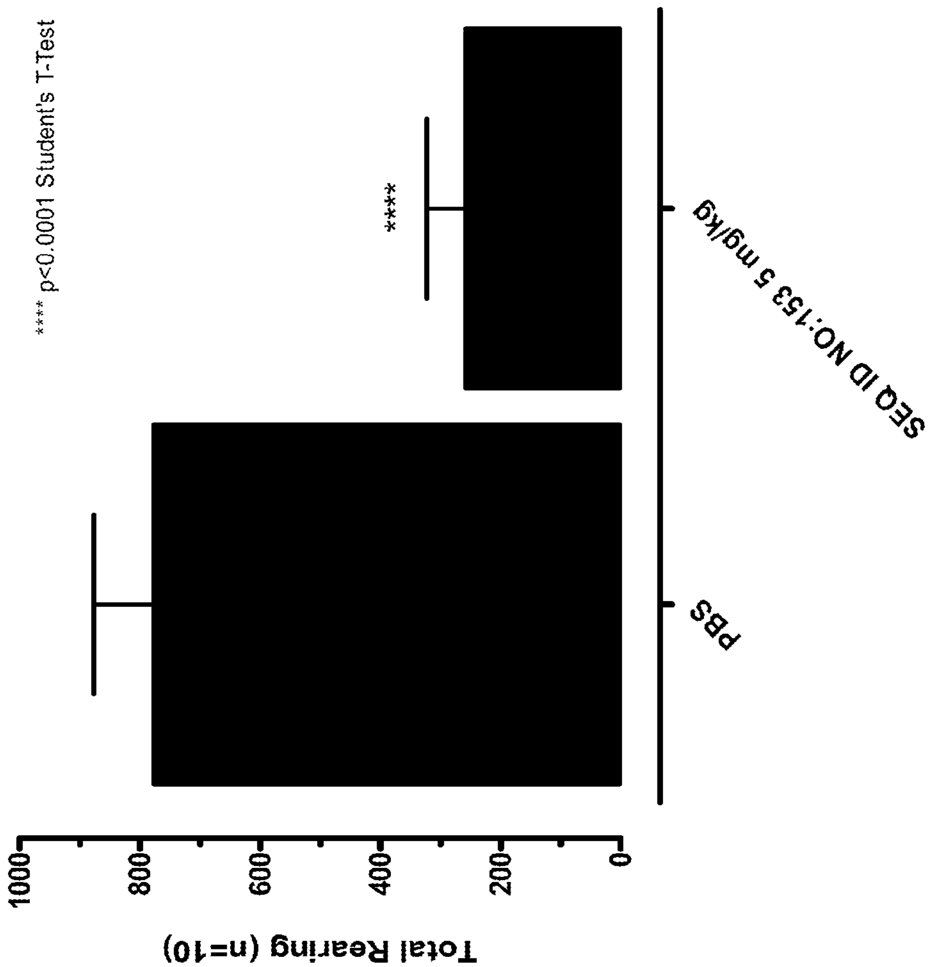

FIG. 109 shows the effect of [Glu28]GpTx-1(1-34) (SEQ ID NO:153) at a 5 mg/kg s.c. dose with a 1-hour pre-treatment time on the total rearing component of locomotor activity in male CD-1 mice. At the 5 mg/kg dose, peptide significantly reduced total rearing relative to the vehicle control.

Figure 110:
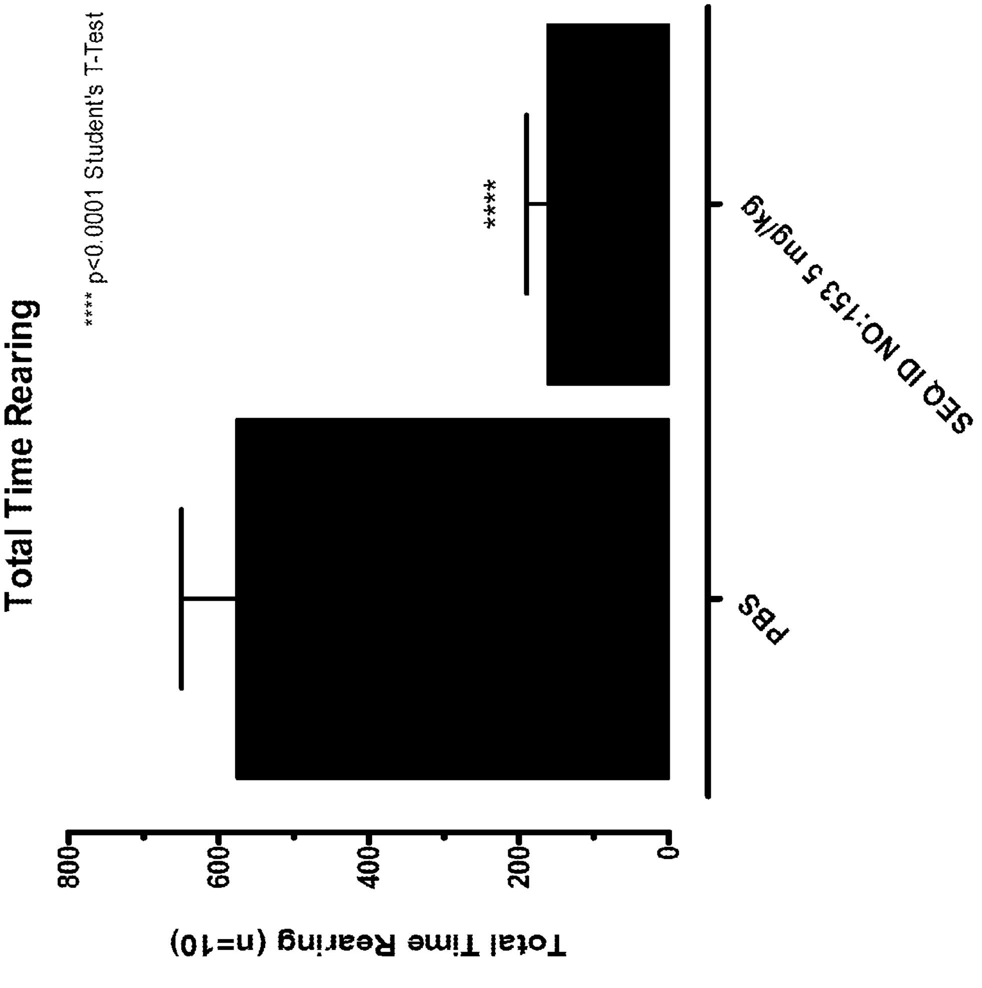

FIG. 110 shows the effect of [Glu28]GpTx-1(1-34) (SEQ ID NO:153) at a 5 mg/kg s.c. dose with a 1-hour pre-treatment time on the total time rearing component of locomotor activity in male CD-1 mice. At the 5 mg/kg dose, peptide significantly reduced the total time rearing relative to the vehicle control.

Figure 111:
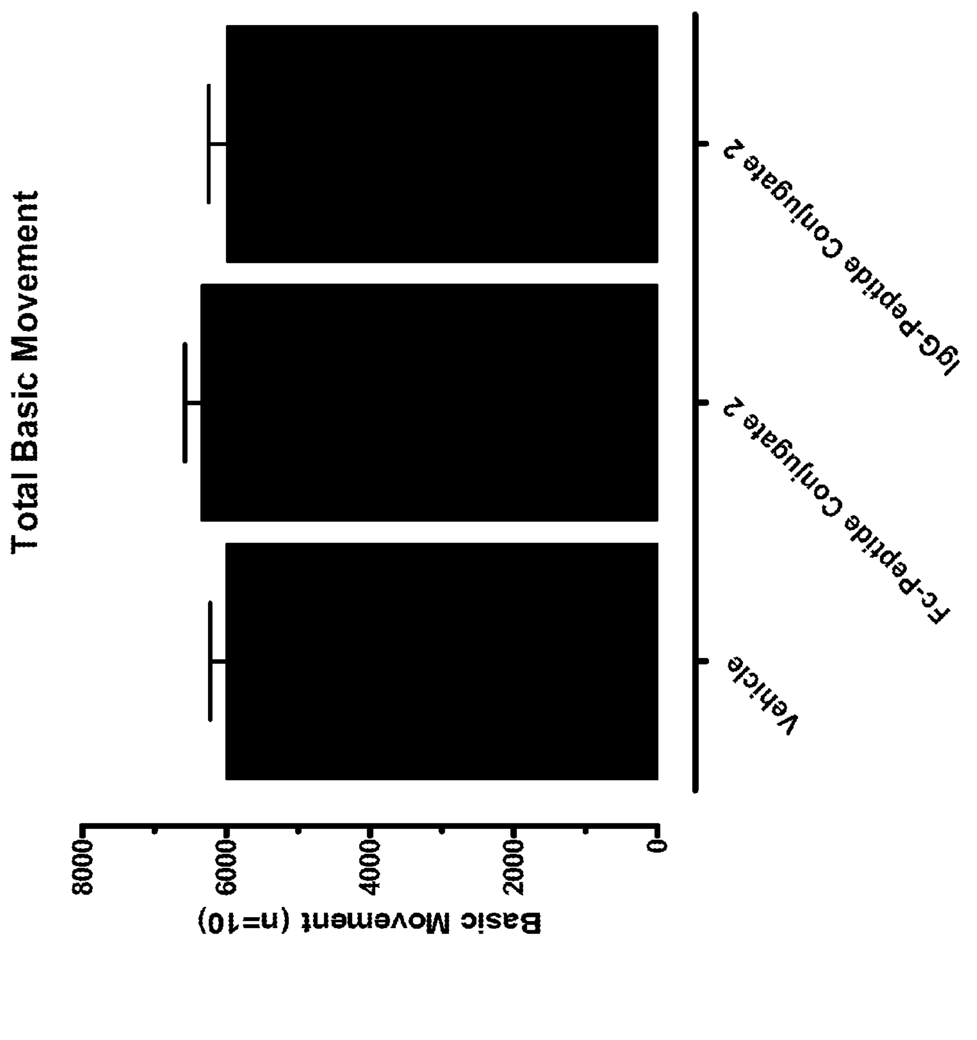

FIG. 111 shows the effects of 10 mg/kg s.c. doses of Fc-peptide Conjugate 2 and Immunoglobulin-peptide Conjugate 2 with a 1-hour pre-treatment time on the total basic movement component of locomotor activity in male CD-1 mice. The peptide conjugate doses did not significantly decrease exploratory behavior or total basic movement relative to the vehicle control. Terminal exposures (peptide conjugate plasma concentrations at 24.5 h post peptide conjugate injection) were 0.034±0.009 μM and 0.051±0.007 μM for the 10 mg/kg s.c. doses of Fc-peptide Conjugate 2 and Immunoglobulin-peptide Conjugate 2, respectively.

Figure 112:
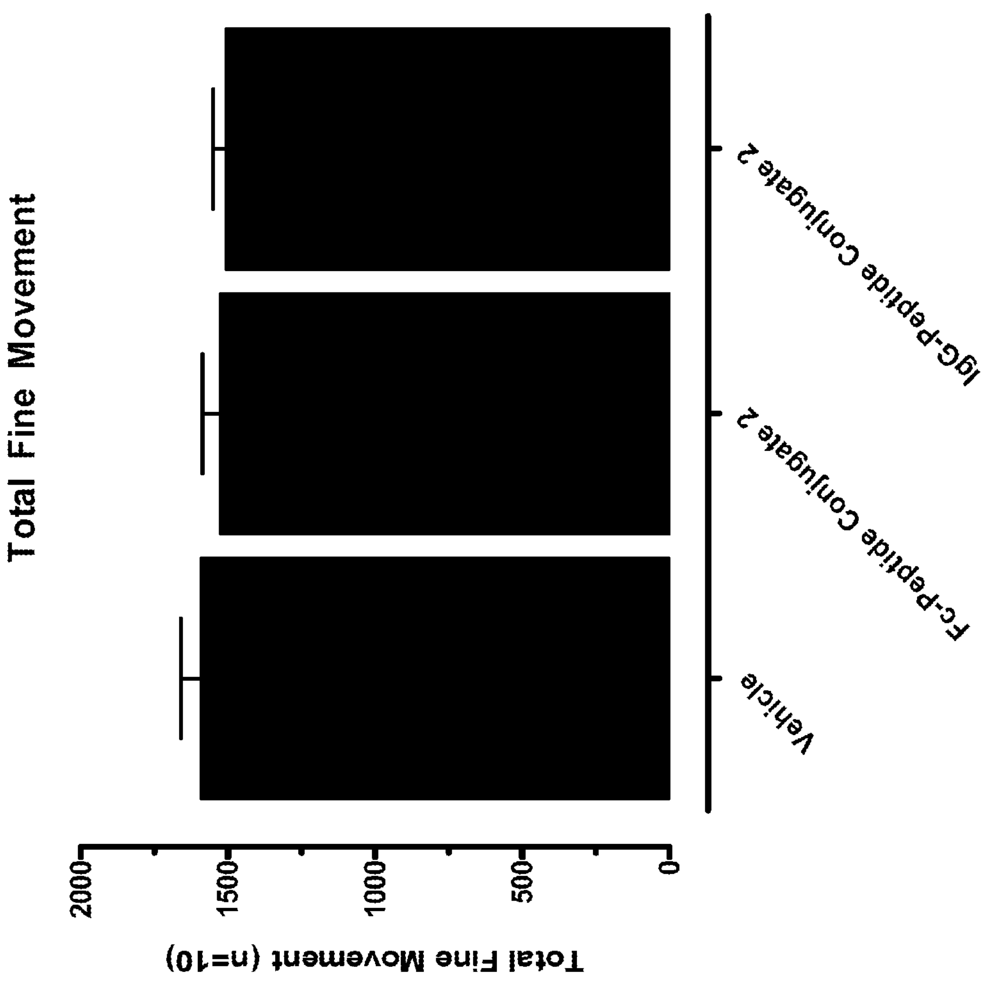

FIG. 112 shows the effects of 10 mg/kg s.c. doses of Fc-peptide Conjugate 2 and Immunoglobulin-peptide Conjugate 2 with a 1-hour pre-treatment time on the fine movement component of locomotor activity in male CD-1 mice. At the 10 mg/kg doses, fine movement was not significantly affected by either peptide conjugate relative to the vehicle control.

Figure 113:
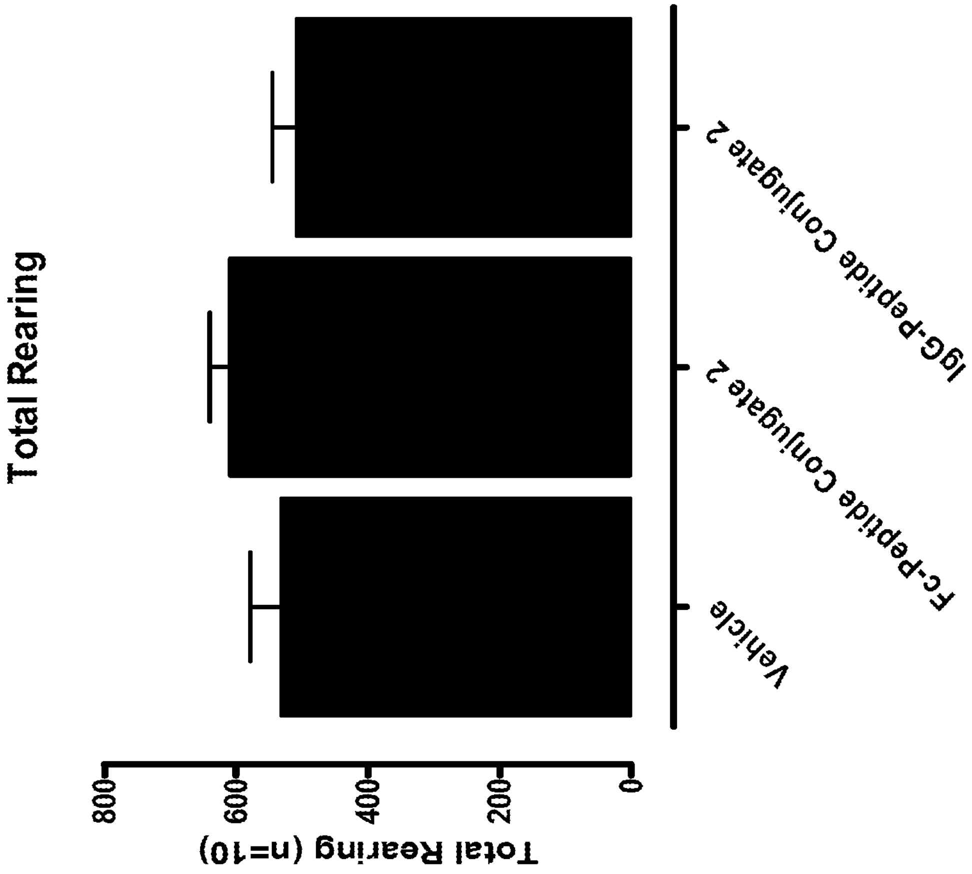

FIG. 113 shows the effects of 10 mg/kg s.c. doses of Fc-peptide Conjugate 2 and Immunoglobulin-peptide Conjugate 2 with a 1-hour pre-treatment time on the total rearing component of locomotor activity in male CD-1 mice. The peptide conjugate doses did not significantly decrease exploratory behavior or total rearing in relation to the vehicle control.

Figure 114:
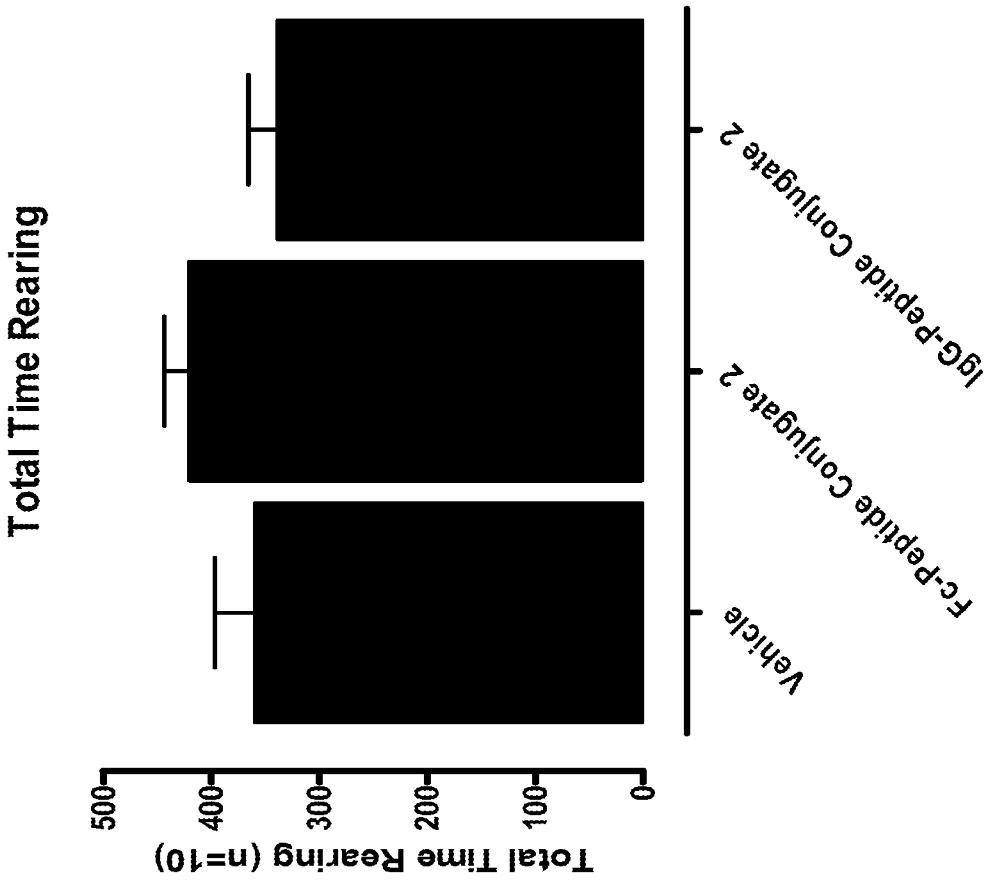

FIG. 114 shows the effects of 10 mg/kg s.c. doses of Fc-peptide Conjugate 2 and Immunoglobulin-peptide Conjugate 2 with a 1-hour pre-treatment time on the total time rearing component of locomotor activity in male CD-1 mice. At the 10 mg/kg doses, total time rearing was not significantly affected by either peptide conjugate relative to the vehicle control.

Figure 115:
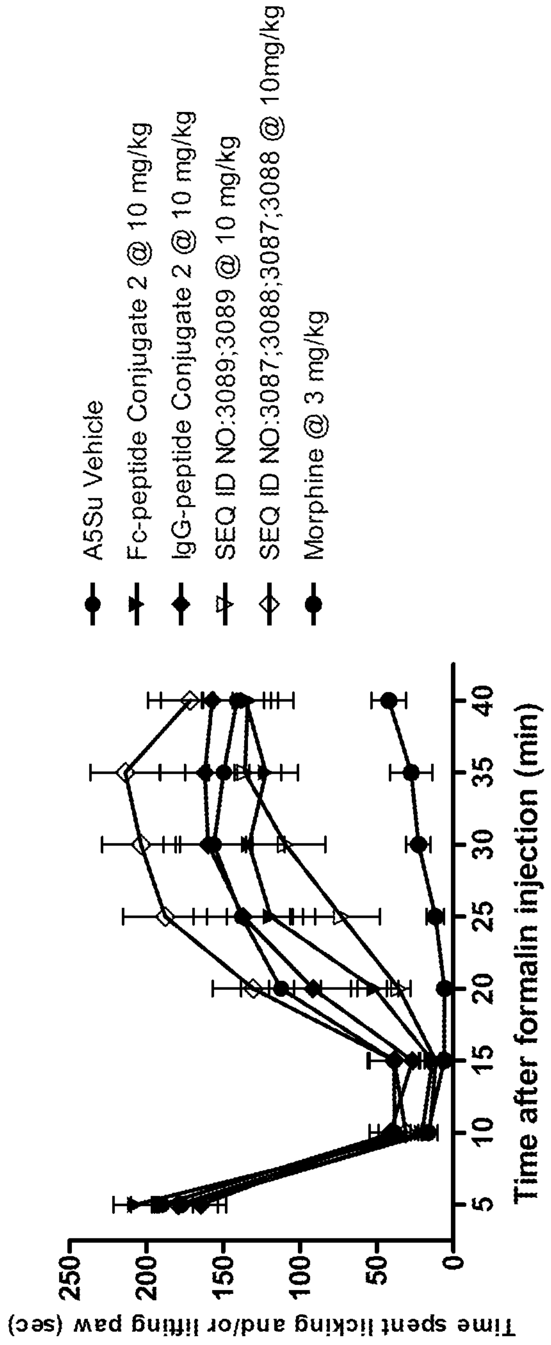

FIG. 115 shows the timecourse of the effects of Fc-peptide Conjugate 2 and Immunoglobulin-peptide Conjugate 2 in the formalin pain model in male CD-1 mice with 1-hour pre-treatment doses of 10 mg/kg s.c. The 10 mg/kg peptide doses and the 3 mg/kg s.c. dose of the positive control morphine (30 minutes pretreatment) had no significant effect in the first phase (0-5 minutes post formalin injection). The 10 mg/kg s.c. doses of Fc-peptide Conjugate 2 and Immunoglobulin-peptide Conjugate 2 did not demonstrate a significant reduction of the time spent lifting/licking in the second phase of the study (5-40 minutes post formalin injection), but the morphine positive control did significantly reduce the time spent lifting/licking in the second phase. Terminal exposures (peptide conjugate plasma concentrations at 45 min post formalin injection) were 0.035±0.011 μM and 0.040±0.011 μM for the 10 mg/kg doses of Fc-peptide Conjugate 2 and Immunoglobulin-peptide Conjugate 2, respectively.

Figure 116:
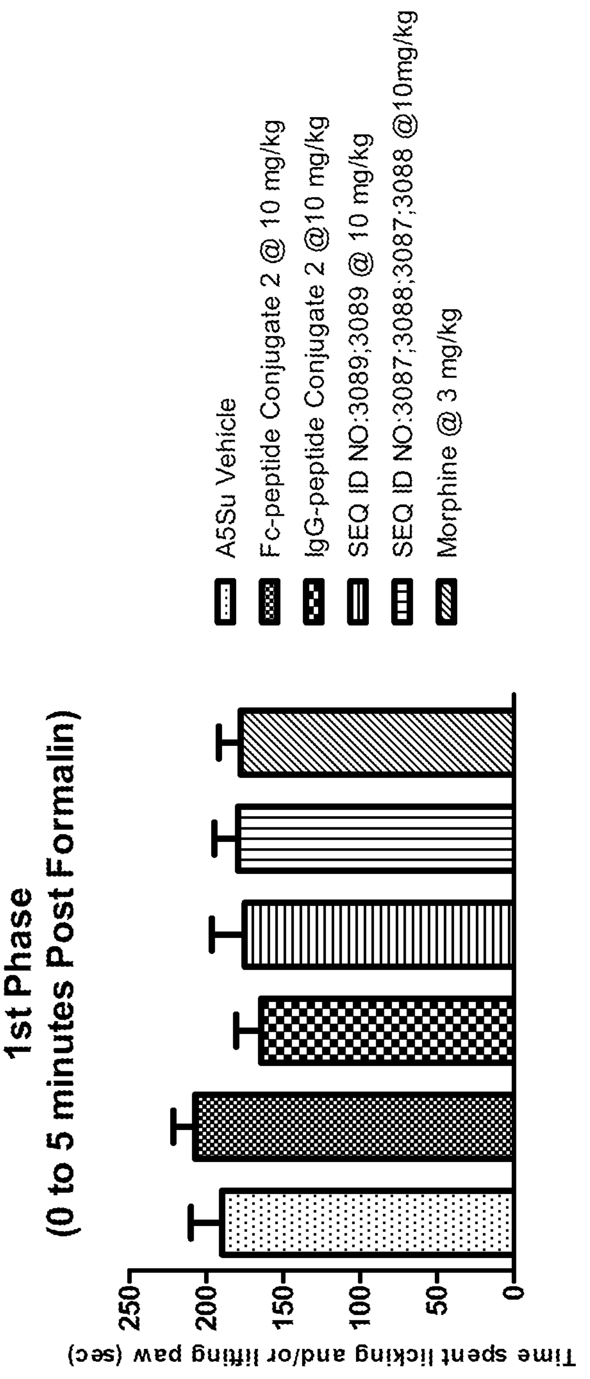

FIG. 116 shows the effects of Fc-peptide Conjugate 2 and Immunoglobulin-peptide Conjugate 2 in the first phase of the formalin pain model in male CD-1 mice with 1-hour pre-treatment doses of 10 mg/kg s.c. The 10 mg/kg s.c. doses of Fc-peptide Conjugate 2 and Immunoglobulin-peptide Conjugate 2 and the 3 mg/kg s.c. dose of morphine had no effect in the first phase (0-5 minutes post formalin injection).

Figure 117:
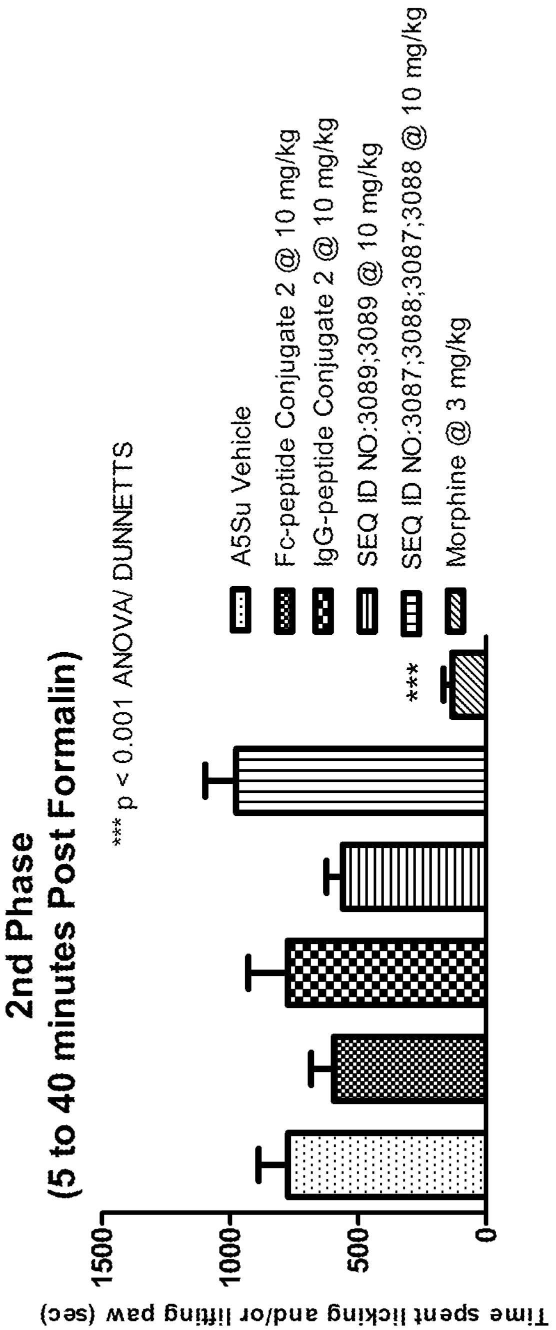

FIG. 117 shows the effects of Fc-peptide Conjugate 2 and Immunoglobulin-peptide Conjugate 2 in the second phase of the formalin pain model (5-40 minutes post formalin injection) in male CD-1 mice with 1 hour pre-treatment doses of 10 mg/kg s.c. The 10 mg/kg s.c. doses of Fc-peptide Conjugate 2 and Immunoglobulin-peptide Conjugate 2 did not demonstrate a significant reduction of the time spent lifting/licking in the second phase of the study relative to the vehicle control. The morphine positive control did significantly reduce the time spent lifting/licking in the second phase.

DETAILED DESCRIPTION OF EMBODIMENTS

The section headings used herein are for organizational purposes only and are not to be construed as limiting the subject matter described.

DEFINITIONS

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular. Thus, as used in this specification and the appended claims, the singular forms "a", "an" and "the" include plural referents unless the context clearly indicates otherwise. For example, reference to "a protein" includes a plurality of proteins; reference to "a cell" includes populations of a plurality of cells.

"Polypeptide" and "protein" are used interchangeably herein and include a molecular chain of two or more amino acids linked covalently through peptide bonds. The terms do not refer to a specific length of the product. Thus, "peptides," and "oligopeptides," are included within the definition of polypeptide. The terms include post-translational modifications of the polypeptide, for example, glycosylations, acetylations, biotinylations, 4-pentynoylations, PEGylations, phosphorylations and the like. In addition, protein fragments, analogs, mutated or variant proteins, fusion proteins and the like are included within the meaning of polypeptide. The terms also include molecules in which one or more amino acid analogs or non-canonical or unnatural amino acids are included as can be expressed recombinantly using known protein engineering techniques. In addition, fusion proteins can be derivatized as described herein by well-known organic chemistry techniques.

A composition of the present invention that includes a peptide or polypeptide of the invention covalently linked, attached, or bound, either directly or indirectly through a linker moiety, to another peptide or polypeptide of the invention or to a half-life extending moiety is a "conjugate" or "conjugated" molecule, whether conjugated by chemical means (e.g., post-translationally or post-synthetically) or by recombinant fusion.

"Biotin" is a water-soluble B-complex vitamin, i.e., vitamin B7, that is composed of an ureido (tetrahydroimidizalone) ring fused with a tetrahydrothiophene ring (See, Formula I).

Formula I

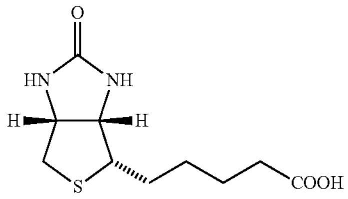

A valeric acid substituent is attached to one of the carbon atoms of the tetrahydrothiophene ring. In nature, biotin is a coenzyme in the metabolism of fatty acids and leucine, and it plays a role in vivo in gluconeogenesis. Biotin binds very tightly to the tetrameric protein avidin (e.g., Chicken avidin, bacterial streptavidin, and neutravidin), with a dissociation equilibrium constant $K_D$ in the order of $10^{-14}$ M to $10^{-16}$ M, which is one of the strongest known protein-ligand interactions, approaching the covalent bond in strength. (Laitinen et al. *Genetically engineered avidins and streptavidins*, Cell Mol Life Sci. 63 (24): 2992-30177 (2006)). The biotin-avidin non-covalent interaction is often used in different biotechnological applications. (See, Laitinen et al., *Genetically engineered avidins and streptavidins*, Cell Mol Life Sci. 63 (24): 2992-30177 (2006)).

"Biotinylated" means that a substance is covalently conjugated to one or more biotin moieties. Biotinylated peptides useful in practicing the invention can be purchased commercially (e.g., Midwest Bio-Tech Inc.) or can be readily synthesized and biotinylated. Biotinylation of compounds, such as peptides, can be by any known chemical technique. These include primary amine biotinylation, sulfhydryl biotinylation, and carboxyl biotinylation. For example, amine groups on the peptide, which are present as lysine side chain epsilon-amines and N-terminal α-amines, are common targets for primary amine biotinylation biotinylation. Amine-reactive biotinylation reagents can be divided into two groups based on water solubility.

1) N-hydroxysuccinimide (NHS)-esters of biotin have poor solubility in aqueous solutions. For reactions in aqueous solution, they must first be dissolved in an organic solvent, then diluted into the aqueous reaction mixture. The most commonly used organic solvents for this purpose are dimethyl sulfoxide (DMSO) and dimethyl formamide (DMF), which are compatible with most proteins at low concentrations.
2) Sulfo-NHS-esters of biotin are more soluble in water, and are dissolved in water just before use because they hydrolyze easily. The water solubility of sulfo-NHS-esters stems from their sulfonate group on the N-hydroxysuccinimide ring and eliminates the need to dissolve the reagent in an organic solvent.

Chemical reactions of NHS- and sulfo-NHS-esters are essentially the same: an amide bond is formed and NHS or sulfo-NHS become leaving groups. Because the targets for the ester are deprotonated primary amines, the reaction is prevalent above pH 7. Hydrolysis of the NHS-ester is a major competing reaction, and the rate of hydrolysis increases with increasing pH. NHS- and sulfo-NHS-esters have a half-life of several hours at pH 7, but only a few minutes at pH 9. The conditions for conjugating NHS-esters to primary amines of peptides include incubation temperatures in the range 4-37° C., reaction pH values in the range 7-9, and incubation times from a few minutes to about 12 hours. Buffers containing amines (such as Tris or glycine) must be avoided because they compete with the reaction. The HABA dye (2-(4-hydroxyazobenzene) benzoic acid) method can be used to determine the extent of biotinylation. Briefly, HABA dye is bound to avidin and yields a characteristic absorbance. When biotin, in the form of biotinylated protein or other molecule, is introduced, it displaces the dye, resulting in a change in absorbance at 500 nm. The absorbance change is directly proportional to the level of biotin in the sample.

"4-pentynoylation" of an amino acid residue is typically by coupling 4-pentynoic acid via a standard amide bond reaction via the N-terminal or at a side chain. When appropriate for additional PEGylations, 4-pentynoylation can alternatively employ an alkyne in the copper-catalyzed 1,3-dipolar cycloaddition reaction (the so-called "Click" reaction) to react with the azide in the azido-PEG molecule to link the peptide and the PEG via a triazole.

An "isolated polypeptide" is a polypeptide molecule that is purified or separated from at least one contaminant polypeptide molecule with which it is ordinarily associated in the natural source of the polypeptide. An isolated polypeptide molecule is other than in the form or setting in which it is found in nature.

"Toxin peptides" include peptides and polypeptides having the same amino acid sequence of a naturally occurring pharmacologically active peptide or polypeptide that can be isolated from a venom, and also include modified peptide analogs of such naturally occurring molecules. (See, e.g., Kalman et al., ShK-Dap22, a potent Kv1.3-specific immunosuppressive polypeptide, J. Biol. Chem. 273(49):32697-707 (1998); Kem et al., U.S. Pat. No. 6,077,680; Mouhat et al., OsK1 derivatives, WO 2006/002850 A2; Chandy et al., Analogs of SHK toxin and their uses in selective inhibition of Kv1.3 potassium channels, WO 2006/042151; Sullivan et al., Toxin Peptide therapeutic agents, WO 2006/116156 A2, all of which are incorporated herein by reference in their entirety). Snakes, scorpions, spiders, bees, snails and sea anemone are a few examples of organisms that produce venom that can serve as a rich source of small bioactive toxin peptides or "toxins" that potently and selectively target ion channels and receptors. GpTx-1 (SEQ ID NO:1); GpTx-2 (SEQ ID NO:467); GpTx-3 (SEQ ID NO:468); GpTx-4 (SEQ ID NO:469); GpTx-5 (SEQ ID NO:470); GpTx-6(1-35) (SEQ ID NO:471); and GpTx-7(1-35) (SEQ ID NO:473) are examples of toxin peptides. Some other examples of toxins that inhibit voltage-gated sodium channels include Huwentoxin-IV (ECLEI FKACN PSNDQ CCKSS KLVCS RKTRW CKYQI-$NH_2$//SEQ ID NO:528) and Huwentoxin-I (ACKGV FDACT PGKNE CCPNR VCSDK HKWCK WKL//SEQ ID NO:529), isolated from the venom of tarantula *Ornithoctonus huwena*; KIIIA (CCNCS SKWCR DHSRC C—$NH_2$//SEQ ID NO:530) isolated from the venom of marine cone snail *Conus kinoshitai*; and ProTxII (YCQKW MWTCD SERKC CEGMV CRLWC KKKLW//SEQ ID NO:531) isolated from the venom of tarantula *Thrixopelma pruriens*. Another example is the alpha toxin OD1 (GVRDAYIADD KNCVYTCASN GYCNTECTKN GAESGYCQWI GRYGNACWCI KLPDEVPIRIPGKCR-$NH_2$// SEQ ID NO:589), a toxin isolated from the venom of the scorpion *Odonthobuthus doriae*. Another example of a toxin peptide is OSK1 (also known as OsK1), a toxin peptide isolated from *Orthochirus scrobiculosus* scorpion venom. (e.g., Mouhat et al., K+ channel types targeted by synthetic OSK1, a toxin from *Orthochirus scrobiculosus* scorpion venom, Biochem. J. 385:95-104 (2005); Mouhat et al., Pharmacological profiling of *Orthochirus scrobiculosus* toxin 1 analogs with a trimmed N-terminal domain, Molec. Pharmacol. 69:354-62 (2006); Mouhat et al., OsK1 derivatives, WO 2006/002850 A2). Another example is ShK, isolated from the venom of the sea anemone *Stichodactyla helianthus*, and its peptide analogs. (E.g., Tudor et al., Ionisation behaviour and solution properties of the potassium-channel blocker ShK toxin, Eur. J. Biochem. 251(1-2):133-41 (1998); Pennington et al., Role of disulfide bonds in the structure and potassium channel blocking activity of ShK toxin, Biochem. 38(44): 14549-58 (1999); Kem et al., ShK toxin compositions and methods of use, U.S. Pat. No. 6,077,680; Lebrun et al., Neuropeptides originating in scorpion, U.S. Pat. No. 6,689,749; Beeton et al., Targeting effector memory T cells with a selective peptide inhibitor of Kv1.3 channels for therapy of autoimmune diseases, Molec. Pharmacol. 67(4):1369-81 (2005); and Sullivan et al., Selective and potent peptide inhibitors of $K_V1.3$, WO 2010/108154 A2).

The toxin peptides are usually between about 20 and about 80 amino acids in length, contain 2-5 disulfide linkages and form a very compact structure. Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency and stability. The majority of scorpion and *Conus* toxin peptides, for example, contain 10-40 amino acids and up to five disulfide bonds, forming extremely compact and constrained structure (microproteins) often resistant to proteolysis. The conotoxin and scorpion toxin peptides can be divided into a number of superfamilies based on their disulfide connections and peptide folds. The solution structure of many toxin peptides has been determined by NMR spectroscopy, illustrating their compact structure and verifying conservation of family folding patterns. (E.g., Tudor et al., Ionisation behaviour and solution properties of the potassium-channel blocker ShK toxin, Eur. J. Biochem. 251(1-2):133-41 (1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from *Orthochirus scrobiculosus* scorpion venom, Biochem. 36(6):1223-32 (1997); del Rio-Portillo et al.; NMR solution structure of Cn12, a novel peptide from the Mexican scorpion *Centruroides noxius* with a typical betatoxin sequence but with alpha-like physiological activity, Eur. J. Biochem. 271(12): 2504-16 (2004); Prochnicka-Chalufour et al., Solution structure of discrepin, a new K+-channel blocking peptide from the alpha-KTx15 subfamily, Biochem. 45(6):1795-1804 (2006)). Other examples are known in the art, or can be found in Sullivan et al., Toxin Peptide Therapeutic Agents, WO06116156 A2 or U.S. Pat. No. 7,833,979; Sullivan et al., Selective and potent peptide inhibitors of $K_V1.3$, WO 2010/108154 A2; Mouhat et al., OsK1 derivatives, WO 2006/002850 A2; Sullivan et al., U.S. patent application Ser. No. 11/978,076 (titled: filed 25 Oct. 2007), Lebrun et al., U.S. Pat. No. 6,689,749, which are each incorporated by reference in their entireties.

The term "peptide analog" refers to a peptide having a sequence that differs from a peptide sequence existing in nature by at least one amino acid residue substitution, internal addition, or internal deletion of at least one amino acid, and/or amino- or carboxy-terminal end truncations or additions, and/or carboxy-terminal amidation. An "internal deletion" refers to absence of an amino acid from a sequence existing in nature at a position other than the N- or C-terminus. Likewise, an "internal addition" refers to presence of an amino acid in a sequence existing in nature at a position other than the N- or C-terminus.

Embodiments of the inventive composition of matter includes a toxin peptide analog, or a pharmaceutically acceptable salt thereof "Toxin peptide analogs" contain modifications of a native toxin peptide sequence of interest (e.g., amino acid residue substitutions, internal additions or insertions, internal deletions, and/or amino- or carboxy-terminal end truncations, or additions as previously described above) relative to a native toxin peptide sequence of interest, such as GpTx-1 (DCLGFMRKCIPDNDKCCRPNLVCSRTHKWCKYVF-$NH_2$//SEQ ID NO:1). Toxin peptide analogs of the present invention are 20 to about 80 amino acid residues long and, in relation to SEQ ID NO:1, have $C^1$-$C^4$, $C^2$-$C^5$ and $C^3$-$C^6$ disulfide (or diselenide) bonding in which, $C^1$, $C^2$, $C^3$, $C^4$, $C^5$ and $C^6$ represent the order of cysteine (or selenocysteine) residues appearing in the primary sequence of the toxin peptide stated conventionally with the N-terminus of the peptide(s) on the left, with the first and sixth cysteines (or selenocysteines) in the amino acid sequence forming a disulfide bond (or diselenide bond, if SeCys), the second and fourth cysteines (or selenocysteines) forming a disulfide bond (or diselenide bond, if SeCys), and the third and fifth cysteines (or selenocysteines) forming a disulfide bond (or diselenide bond, if SeCys). As described herein, the toxin peptide analogs of the present invention can also have additional amino acid residues at the N-terminal and/or C-terminal ends, in relation to SEQ ID NO:1.

By "physiologically acceptable salt" of the composition of matter, for example a salt of the toxin peptide analog, is meant any salt or salts that are known or later discovered to be pharmaceutically acceptable. Some non-limiting examples of pharmaceutically acceptable salts are: acetate; trifluoroacetate; hydrohalides, such as hydrochloride and hydrobromide; sulfate; citrate; maleate; tartrate; glycolate; gluconate; succinate; mesylate; besylate; salts of gallic acid esters (gallic acid is also known as 3,4, 5 trihydroxybenzoic acid) such as PentaGalloylGlucose (PGG) and epigallocatechin gallate (EGCG), salts of cholesteryl sulfate, pamoate, tannate and oxalate salts.

The term "fusion protein" indicates that the protein includes polypeptide components derived from more than one parental protein or polypeptide. Typically, a fusion protein is expressed from a fusion gene in which a nucleotide sequence encoding a polypeptide sequence from one protein is appended in frame with, and optionally separated by a linker from, a nucleotide sequence encoding a polypeptide sequence from a different protein. The fusion gene can then be expressed by a recombinant host cell as a single protein.

The terms "-mimetic peptide," "peptide mimetic," and "-agonist peptide" refer to a peptide or protein having biological activity comparable to a naturally occurring protein of interest, for example, but not limited to, a toxin peptide molecule. These terms further include peptides that indirectly mimic the activity of a naturally occurring peptide molecule, such as by potentiating the effects of the naturally occurring molecule.

The term "-antagonist peptide," "peptide antagonist," and "inhibitor peptide" refer to a peptide that blocks or in some way interferes with the biological activity of a receptor of interest, or has biological activity comparable to a known antagonist or inhibitor of a receptor of interest, such as, but not limited to, an ion channel (e.g., Kv1.3) or a G-Protein Coupled Receptor (GPCR).

A "domain" of a protein is any portion of the entire protein, up to and including the complete protein, but typically comprising less than the complete protein. A domain can, but need not, fold independently of the rest of the protein chain and/or be correlated with a particular biological, biochemical, or structural function or location (e.g., a ligand binding domain, or a cytosolic, transmembrane or extracellular domain).

As used herein "soluble" when in reference to a protein produced by recombinant DNA technology in a host cell is a protein that exists in aqueous solution; if the protein contains a twin-arginine signal amino acid sequence the soluble protein is exported to the periplasmic space in gram negative bacterial hosts, or is secreted into the culture medium by eukaryotic host cells capable of secretion, or by bacterial host possessing the appropriate genes (e.g., the kil gene). Thus, a soluble protein is a protein which is not found in an inclusion body inside the host cell. Alternatively, depending on the context, a soluble protein is a protein which is not found integrated in cellular membranes. In contrast, an insoluble protein is one which exists in denatured form inside cytoplasmic granules (called an inclusion body) in the host cell, or again depending on the context, an insoluble protein is one which is present in cell membranes, including but not limited to, cytoplasmic membranes, mitochondrial membranes, chloroplast membranes, endoplasmic reticulum membranes, etc.

A distinction is also drawn between proteins which are "soluble" (i.e., dissolved or capable of being dissolved) in an aqueous solution devoid of significant amounts of ionic detergents (e.g., SDS) or denaturants (e.g., urea, guanidine hydrochloride) and proteins which exist as a suspension of insoluble protein molecules dispersed within the solution. A "soluble" protein will not be removed from a solution containing the protein by centrifugation using conditions sufficient to remove cells present in a liquid medium (e.g., centrifugation at 5,000×g for 4-5 minutes). In some embodiments of the inventive composition, the toxin peptide analog is synthesized by the host cell and segregated in an insoluble form within cellular inclusion bodies, which can then be purified from other cellular components in a cell extract with relative ease, and the toxin peptide analog can in turn be solubilized, refolded and/or further purified.

A distinction is drawn between a "soluble" protein (i.e., a protein which when expressed in a host cell is produced in a soluble form) and a "solubilized" protein. An insoluble recombinant protein found inside an inclusion body or found integrated in a cell membrane may be solubilized (i.e., rendered into a soluble form) by treating purified inclusion bodies or cell membranes with denaturants such as guanidine hydrochloride, urea or sodium dodecyl sulfate (SDS). These denaturants must then be removed from the solubilized protein preparation to allow the recovered protein to renature (refold). Although the inventive compositions can be refolded in active form, not all proteins will refold into an active conformation after solubilization in a denaturant and removal of the denaturant. Many proteins precipitate upon removal of the denaturant. SDS may be used to solubilize inclusion bodies and cell membranes and will maintain the proteins in solution at low concentration. However, dialysis will not always remove all of the SDS (SDS can form micelles which do not dialyze out); therefore, SDS-solubilized inclusion body protein and SDS-solubilized cell membrane protein is soluble but not refolded.

A "secreted" protein refers to those proteins capable of being directed to the ER, secretory vesicles, or the extracellular space as a result of a secretory signal peptide sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage. In some other embodiments of the inventive composition, the toxin peptide analog can be synthesized by the host cell as a secreted protein, which can then be further purified from the extracellular space and/or medium.

The term "recombinant" indicates that the material (e.g., a nucleic acid or a polypeptide) has been artificially or synthetically (i.e., non-naturally) altered by human intervention. The alteration can be performed on the material within, or removed from, its natural environment or state. For example, a "recombinant nucleic acid" is one that is made by recombining nucleic acids, e.g., during cloning, DNA shuffling or other well known molecular biological procedures. Examples of such molecular biological procedures are found in Maniatis et al., Molecular Cloning. A Laboratory Manual. Cold Spring Harbor Laboratory, Cold Spring Harbor, N.Y. (1982). A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid.

The term "polynucleotide" or "nucleic acid" includes both single-stranded and double-stranded nucleotide polymers containing two or more nucleotide residues. The nucleotide residues comprising the polynucleotide can be ribonucleotides or deoxyribonucleotides or a modified form of either type of nucleotide. Said modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phosphoraniladate and phosphoroamidate.

The term "oligonucleotide" means a polynucleotide comprising 200 or fewer nucleotide residues. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides may be single stranded or double stranded, e.g., for use in the construction of a mutant gene. Oligonucleotides may be sense or antisense oligonucleotides. An oligonucleotide can include a label, including an isotopic label (e.g., $^{125}I$, $^{14}C$, $^{13}C$, $^{35}S$, $^{3}H$, $^{2}H$, $^{13}N$, $^{15}N$, $^{18}C$, $^{17}O$, etc.), for ease of quantification or detection, a fluorescent label, a hapten or an antigenic label, for detection assays. Oligonucleotides may be used, for example, as PCR primers, cloning primers or hybridization probes.

A "polynucleotide sequence" or "nucleotide sequence" or "nucleic acid sequence," as used interchangeably herein, is the primary sequence of nucleotide residues in a polynucleotide, including of an oligonucleotide, a DNA, and RNA, a nucleic acid, or a character string representing the primary sequence of nucleotide residues, depending on context. From any specified polynucleotide sequence, either the given nucleic acid or the complementary polynucleotide sequence can be determined. Included are DNA or RNA of genomic or synthetic origin which may be single- or double-stranded, and represent the sense or antisense strand. Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

As used herein, an "isolated nucleic acid molecule" or "isolated nucleic acid sequence" is a nucleic acid molecule that is either (1) identified and separated from at least one contaminant nucleic acid molecule with which it is ordinarily associated in the natural source of the nucleic acid or (2) cloned, amplified, tagged, or otherwise distinguished from background nucleic acids such that the sequence of the nucleic acid of interest can be determined. An isolated nucleic acid molecule is other than in the form or setting in which it is found in nature. However, an isolated nucleic acid molecule includes a nucleic acid molecule contained in cells that ordinarily express a polypeptide (e.g., an oligopeptide or antibody) where, for example, the nucleic acid molecule is in a chromosomal location different from that of natural cells.

As used herein, the terms "nucleic acid molecule encoding," "DNA sequence encoding," and "DNA encoding" refer to the order or sequence of deoxyribonucleotides along a strand of deoxyribonucleic acid. The order of these deoxyribonucleotides determines the order of ribonucleotides along the mRNA chain, and also determines the order of amino acids along the polypeptide (protein) chain. The DNA sequence thus codes for the RNA sequence and for the amino acid sequence.

The term "gene" is used broadly to refer to any nucleic acid associated with a biological function. Genes typically include coding sequences and/or the regulatory sequences required for expression of such coding sequences. The term "gene" applies to a specific genomic or recombinant sequence, as well as to a cDNA or mRNA encoded by that sequence. A "fusion gene" contains a coding region that encodes a polypeptide with portions from different proteins that are not naturally found together, or not found naturally together in the same sequence as present in the encoded fusion protein (i.e., a chimeric protein). Genes also include non-expressed nucleic acid segments that, for example, form recognition sequences for other proteins. Non-expressed regulatory sequences including transcriptional control elements to which regulatory proteins, such as transcription factors, bind, resulting in transcription of adjacent or nearby sequences.

"Expression of a gene" or "expression of a nucleic acid" means transcription of DNA into RNA (optionally including modification of the RNA, e.g., splicing), translation of RNA into a polypeptide (possibly including subsequent post-translational modification of the polypeptide), or both transcription and translation, as indicated by the context.

As used herein the term "coding region" or "coding sequence" when used in reference to a structural gene refers to the nucleotide sequences which encode the amino acids found in the nascent polypeptide as a result of translation of an mRNA molecule. The coding region is bounded, in eukaryotes, on the 5' side by the nucleotide triplet "ATG" which encodes the initiator methionine and on the 3' side by one of the three triplets which specify stop codons (i.e., TAA, TAG, TGA).

The term "control sequence" or "control signal" refers to a polynucleotide sequence that can, in a particular host cell, affect the expression and processing of coding sequences to which it is ligated. The nature of such control sequences may depend upon the host organism. In particular embodiments, control sequences for prokaryotes may include a promoter, a ribosomal binding site, and a transcription termination sequence. Control sequences for eukaryotes may include promoters comprising one or a plurality of recognition sites for transcription factors, transcription enhancer sequences or elements, polyadenylation sites, and transcription termination sequences. Control sequences can include leader sequences and/or fusion partner sequences. Promoters and enhancers consist of short arrays of DNA that interact specifically with cellular proteins involved in transcription (Maniatis, et al., Science 236:1237 (1987)). Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. Some eukaryotic promoters and enhancers have a broad host range while others are functional in a limited subset of cell types (for review see Voss, et al., Trends Biochem. Sci., 11:287 (1986) and Maniatis, et al., Science 236:1237 (1987)).

The term "vector" means any molecule or entity (e.g., nucleic acid, plasmid, bacteriophage or virus) used to transfer protein coding information into a host cell.

The term "expression vector" or "expression construct" as used herein refers to a recombinant DNA molecule containing a desired coding sequence and appropriate nucleic acid control sequences necessary for the expression of the operably linked coding sequence in a particular host cell. An expression vector can include, but is not limited to, sequences that affect or control transcription, translation, and, if introns are present, affect RNA splicing of a coding region operably linked thereto. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. Such techniques are well known in the art. (E.g., Goodey, Andrew R.; et al., Peptide and DNA sequences, U.S. Pat. No. 5,302,697; Weiner et al., Compositions and methods for protein secretion, U.S. Pat. No. 6,022,952 and U.S. Pat. No. 6,335,178; Uemura et al., Protein expression vector and utilization thereof, U.S. Pat. No. 7,029,909; Ruben et al., 27 human secreted proteins, US 2003/0104400 A1).

The terms "in operable combination", "in operable order" and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed, or is capable of being transformed, with a nucleic acid and thereby expresses a gene of interest. The term includes the progeny of the parent cell, whether or not the progeny is identical in morphology or in genetic make-up to the original parent cell, so long as the gene of interest is present. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK-293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art.

The term "transfection" means the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., 1973, Virology 52:456; Sambrook et al., 2001, Molecular Cloning: A Laboratory Manual, supra; Davis et al., 1986, Basic Methods in Molecular Biology, Elsevier; Chu et al., 1981, Gene 13:197. Such techniques can be used to introduce one or more exogenous DNA moieties into suitable host cells.

The term "transformation" refers to a change in a cell's genetic characteristics, and a cell has been transformed when it has been modified to contain new DNA or RNA. For example, a cell is transformed where it is genetically modified from its native state by introducing new genetic material via transfection, transduction, or other techniques. Following transfection or transduction, the transforming DNA may recombine with that of the cell by physically integrating into a chromosome of the cell, or may be maintained transiently as an episomal element without being replicated, or may replicate independently as a plasmid. A cell is considered to have been "stably transformed" when the transforming DNA is replicated with the division of the cell.

The term "transgene" refers to an isolated nucleotide sequence, originating in a different species from the host, that may be inserted into one or more cells of a mammal or mammalian embryo. The transgene optionally may be operably linked to other genetic elements (such as a promoter, poly A sequence and the like) that may serve to modulate, either directly, or indirectly in conjunction with the cellular machinery, the transcription and/or expression of the transgene. Alternatively or additionally, the transgene may be linked to nucleotide sequences that aid in integration of the transgene into the chromosomal DNA of the mammalian cell or embryo nucleus (as for example, in homologous recombination). The transgene may be comprised of a nucleotide sequence that is either homologous or heterologous to a particular nucleotide sequence in the mammal's endogenous genetic material, or is a hybrid sequence (i.e. one or more portions of the transgene are homologous, and one or more portions are heterologous to the mammal's genetic material). The transgene nucleotide sequence may encode a polypeptide or a variant of a polypeptide, found endogenously in the mammal, it may encode a polypeptide not naturally occurring in the mammal (i.e. an exogenous polypeptide), or it may encode a hybrid of endogenous and exogenous polypeptides. Where the transgene is operably linked to a promoter, the promoter may be homologous or heterologous to the mammal and/or to the transgene. Alternatively, the promoter may be a hybrid of endogenous and exogenous promoter elements (enhancers, silencers, suppressors, and the like).

Peptides.

Recombinant DNA- and/or RNA-mediated protein expression and protein engineering techniques, or any other methods of preparing peptides, are applicable to the making of the inventive polypeptides, e.g., toxin peptide analogs and fusion protein conjugates thereof (e.g., fusion proteins containing a toxin peptide analog and an immunoglobulin Fc domain, transthyretin, or human serum albumin). For example, the peptides can be made in transformed host cells. Briefly, a recombinant DNA molecule, or construct, coding for the peptide is prepared. Methods of preparing such DNA molecules are well known in the art. For instance, sequences encoding the peptides can be excised from DNA using suitable restriction enzymes. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art. In addition, the DNA optionally further encodes, 5' to the coding region of a fusion protein, a signal peptide sequence (e.g., a secretory signal peptide) operably linked to the expressed toxin peptide analog. For further examples of appropriate recombinant methods and exemplary DNA constructs useful for recombinant expression of the inventive compositions by mammalian cells, including dimeric Fc fusion proteins ("peptibodies") or chimeric immunoglobulin(light chain+heavy chain)-Fc heterotrimers ("hemibodies"), conjugated to pharmacologically active toxin peptide analogs of the invention, see, e.g., Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties.

Peptide compositions of the present invention can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Suitable techniques are well known in the art. (E.g., Merrifield (1973), Chem. Polypeptides, pp. 335-61 (Katsoyannis and Panayotis eds.); Merrifield (1963), J. Am. Chem. Soc. 85: 2149; Davis et al. (1985), Biochem. Intl. 10: 394-414; Stewart and Young (1969), Solid Phase Peptide Synthesis; U.S. Pat. No. 3,941,763; Finn et al. (1976), The Proteins (3rd ed.) 2: 105-253; and Erickson et al. (1976), The Proteins (3rd ed.) 2: 257-527; "Protecting Groups in Organic Synthesis," 3rd Edition, T. W. Greene and P. G. M. Wuts, Eds., John Wiley & Sons, Inc., 1999; NovaBiochem Catalog, 2000; "Synthetic Peptides, A User's Guide," G. A. Grant, Ed., W.H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000, G. B. Fields et al., Synthetic Peptides: A User's Guide, 1990, 77-183). For further examples of synthetic and purification methods known in the art, which are applicable to making the inventive compositions of matter, see, e.g., Sullivan et al., Toxin Peptide Therapeutic Agents, US2007/0071764 and Sullivan et al., Toxin Peptide Therapeutic Agents, PCT/US2007/022831, published as WO 2008/088422 A2, which are both incorporated herein by reference in their entireties.

In further describing the toxin peptide analogs herein, a one-letter abbreviation system is frequently applied to designate the identities of the twenty "canonical" amino acid residues generally incorporated into naturally occurring peptides and proteins (Table 2). Such one-letter abbreviations are entirely interchangeable in meaning with three-letter abbreviations, or non-abbreviated amino acid names. Within the one-letter abbreviation system used herein, an upper case letter indicates a L-amino acid, and a lower case letter indicates a D-amino acid. For example, the abbreviation "R" designates L-arginine and the abbreviation "r" designates D-arginine.

TABLE 2

One-letter abbreviations for the canonical amino acids. Three-letter abbreviations are in parentheses.

| | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence is typically designated herein with a one-letter abbreviation for the amino acid residue in a particular position, followed by the numerical amino acid position relative to a native sequence of interest, which is then followed by the one-letter symbol for the amino acid residue substituted in. For example, "T30D" symbolizes a substitution of a threonine residue by an aspartate residue at amino acid position 30, relative to the native sequence of interest.

Non-canonical amino acid residues can be incorporated into a peptide within the scope of the invention by employing known techniques of protein engineering that use recombinantly expressing cells. (See, e.g., Link et al., Non-canonical amino acids in protein engineering, Current Opinion in Biotechnology, 14(6):603-609 (2003)). The term "non-canonical amino acid residue" refers to amino acid residues in D- or L-form that are not among the 20 canonical amino acids generally incorporated into naturally occurring proteins, for example, β-amino acids, homoamino acids, cyclic amino acids and amino acids with derivatized side chains. Examples include (in the L-form or D-form) β-alanine, β-aminopropionic acid, piperidinic acid, aminocaprioic acid, aminoheptanoic acid, aminopimelic acid, desmosine, diaminopimelic acid, $N^\alpha$-ethylglycine, $N^\alpha$-ethylaspargine, hydroxylysine, allo-hydroxylysine, isodesmosine, allo-isoleucine, ω-methylarginine, $N^\alpha$-methylglycine, $N^\alpha$-methylisoleucine, $N^\alpha$-methylvaline, γ-carboxyglutamate, ε-N,N,N-trimethyllysine, ε-N-acetyllysine, O-phosphoserine, $N^\alpha$-acetylserine, $N^\alpha$-formylmethionine, 3-methylhistidine, 5-hydroxylysine, and other similar amino acids, and those listed in Table 3 below, and derivatized forms of any of these as described herein. Table 3 contains some exemplary non-canonical amino acid residues that are useful in accordance with the present invention and associated abbreviations as typically used herein, although the skilled practitioner will understand that different abbreviations and nomenclatures may be applicable to the same substance and appear interchangeably herein. Some amino acid sequences, as recited herein may include "{H}-" at the N-terminal, which represents an N-terminal amino group, and/or may include "-{Free Acid}" at the C-terminal, which represents a C-terminal carboxy group.

TABLE 3

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| Acetamidomethyl | Acm |
| Acetylarginine | acetylarg |
| α-aminoadipic acid | Aad |
| aminobutyric acid | Abu |
| 2-aminobutyric acid | 2-Abu |
| 6-aminohexanoic acid | Ahx; εAhx |
| 3-amino-6-hydroxy-2-piperidone | Ahp |
| 2-aminoindane-2-carboxylic acid | Aic |
| α-amino-isobutyric acid | Aib |
| 3-amino-2-naphthoic acid | Anc |
| 2-aminotetraline-2-carboxylic acid | Atc |
| Aminophenylalanine | Aminophe; Amino-Phe |
| 4-amino-phenylalanine (also known as para-aminophenylalanine) | 4AmP; 4-AminoF; 4-Amino-Phe |
| 4-amidino-phenylalanine | 4AmPhe |
| 2-amino-2-(1-carbamimidoylpiperidin-4-yl)acetic acid | 4AmPig |
| ω-N-methylarginine | R(Me) |
| Arg ψ(CH₂NH) -reduced amide bond | rArg |
| 3-(1,2,3-triazol-4-yl)Alanine | Atz |
| (S)-2-amino-3-(1-(1-bromo-2-oxo- | Atz(PEG3- |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| 6,9,12-trioxa-3-azatetradecan-14-yl)-1H-1,2,3-triazol-4-yl)propanoic acid | bromoacetamide) |
| 3-(1-(O-(aminoethyl)-O'-(ethylene)-decaethyleneglycol)-1,2,3-triazol-4-yl)Alanine | Atz(amino-PEG10) |
| 3-(1-(O-(aminoethyl)-O'-(ethylene)-ethyleneglycol450avg)-1,2,3-triazol-4-yl)Alanine | Atz(20 kDa PEG) |
| (S)-2-amino-3-(1-(2-oxo-6,9,12,15,18,21,24,27,30,33,36-undecaoxa-3-azaoctatriacontan-38-yl)-1H-1,2,3-triazol-4-yl)propanoic acid | Atz(PEG11-(acetamidomethyl) |
| (S)-2-amino-3-(1-(1-hydroxy-5-oxo-9,12,15,18,21,24,27,30,33,36,39-undecaoxa-3-thia-6-azahentetracontan-41-yl)-1H-1,2,3-triazol-4-yl)propanoic acid | Atz(PEG11-((2-hydroxyethyl)thio)acetamide) |
| (S)-2-amino-3-(1-(1-bromo-2-oxo-6,9,12,15,18,21,24,27,30,33,36-undecaoxa-3-azaoctatriacontan-38-yl)-1H-1,2,3-triazol-4-yl)propanoic acid | Atz(PEG11-bromoacetamide) |
| (S)-2-amino-6-(3-(1-(1-bromo-2-oxo-6,9,12,15,18,21,24,27,30,33,36-undecaoxa-3-azaoctatriacontan-38-yl)-1H-1,2,3-triazol-4-yl)propanamido)hexanoic acid | K(ethyl-triazole-PEG11-bromoacetamide) |
| β-alanine | bA |
| β-homoarginine | bhArg |
| β-homolysine | bhomoK |
| β-homo Tic | BhTic |
| β-homophenylalanine | BhPhe |
| β-homoproline | BhPro |
| β-homotryptophan | BhTrp |
| 4,4'-biphenylalanine; 4-phenyl-phenylalanine; or biphenylalanine | Bip; 4Bip |
| β, β-diphenyl-alanine | BiPhA |
| β-phenylalanine | BPhe |
| p-carboxyl-phenylalanine | Cpa |
| Citrulline | Cit |
| Cyclohexylalanine | Cha |
| Cyclohexylglycine | Chg |
| Cyclopentylglycine | Cpg |
| 4-tert-butyl-L-phenylalanine | 4tBu—F |
| 4-benzoyl-L-phenylalanine | 4-Bz-F |
| 2-chloro-L-phenylalanine | 2-Cl—F |
| 4-trifluoromethyl-L-phenylalanine | 4CF3—F |
| 4-fluoro-L-phenylalanine | 4-F—F |
| 4-methyl-L-phenylalanine | 4-Me—F |
| 2-amino-3-guanidinopropanoic acid | 3G-Dpr |
| α, γ-diaminobutyric acid | Dab |
| 2,4-diaminobutyric acid | Dbu |
| diaminopropionic acid | Dap |
| 3,4-dichloro-L-phenylalanine | DiCl—F |
| 3,4-dimethoxy-L-phenylalanine | DiMeO—F |
| α, β-diaminopropionoic acid (or 2,3-diaminopropiooic acid | Dpr |
| 3,3-diphenylalanine | Dip |
| 4-guanidino phenylalanine | Guf |
| 4-guanidino proline | 4GuaPr |
| Homoarginine | hArg; hR |
| Homocitrulline | hCit |
| Homoglutamine | hQ |
| Homoleucine | hLeu; hL |
| Homolysine | hLys; hK; homoLys |
| Homophenylalanine | hPhe; homoPhe |
| 4-hydroxyproline (or hydroxyproline) | Hyp |
| 2-indanylglycine (or indanylglycine) | Igl |
| indoline-2-carboxylic acid | Idc |
| Iodotyrosine | I-Tyr |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| Lys ψ($CH_2NH$)-reduced amide bond | rLys |
| (S)-6-((S)-2-acetamidopent-4-ynamido)-2-aminohexanoic acid | K(Ac-Pra) |
| N-ϵ-biotinyl-L-lysine | K(Biotin) |
| (S)-2,2',2''-(10-(2-((5-amino-5-carboxypentyl)amino)-2-oxoethyl)-1,4,7,10-tetraazacyclododecane-1,4,7-triyl)triacetic acid | K(DOTA) |
| (S)-2-amino-6-(pent-4-ynamido)hexanoic acid | K(4-Pen) |
| methionine oxide | Met[O] |
| methionine sulfone | $Met[O]_2$ |
| $N^{\alpha}$-methylarginine | NMeR |
| Nα-[$(CH_2)_3NHCH(NH)NH_2$] substituted glycine | N-Arg |
| $N^{\alpha}$-methylcitrulline | NMeCit |
| $N^{\alpha}$-methylglutamine | NMeQ |
| $N^{\alpha}$-methylhomocitrulline | $N^{\alpha}$-MeHoCit |
| $N^{\alpha}$-methylhomolysine | NMeHoK |
| $N^{\alpha}$-methylleucine | $N^{\alpha}$-MeL; NMeL; NMeLeu; NMe-Leu |
| $N^{\alpha}$-methyllysine | NMe-Lys |
| Nϵ-methyl-lysine | N-eMe-K |
| Nϵ-ethyl-lysine | N-eEt-K |
| Nϵ-isopropyl-lysine | N-eIPr-K |
| $N^{\alpha}$-methylnorleucine | NMeNle; NMe-Nle |
| $N^{\alpha}$-methylornithine | $N^{\alpha}$-MeOrn; NMeOrn |
| $N^{\alpha}$-methylphenylalanine | NMe-Phe |
| 1'N-methyltryptophan | 1'NMeW |
| 4-methyl-phenylalanine | MePhe |
| α-methylphenyalanine | AMeF |
| $N^{\alpha}$-methylthreonine | NMe-Thr; NMeThr |
| $N^{\alpha}$-methylvaline | NMeVal; NMe-Val |
| Nϵ-(O-(aminoethyl)-O'-(2-propanoyl)-undecaethyleneglycol)-Lysine | K(NPeg11) |
| Nϵ-(O-(aminoethyl)-O'-(2-propanoyl)-(ethyleneglycol)27-Lysine | K(NPeg27) |
| 3-(1-naphthyl)alanine | 1-Nal; 1Nal |
| 3-(2-naphthyl)alanine | 2-Nal; 2Nal |
| nipecotic acid | Nip |
| Nitrophenylalanine | nitrophe |
| norleucine | Nle |
| norvaline | Nva or Nvl |
| O-methyltyrosine | Ome-Tyr |
| (S)-octylglycine | OctylG |
| octahydroindole-2-carboxylic acid | Oic |
| Ornithine | Orn |
| Orn ψ(CH2NH)-reduced amide bond | rOrn |
| pyroglutamic acid | pGlu; PE; pE |
| L-phosphoserine | pS |
| 4-piperidinylalanine | 4PipA |
| 4-pyridinylalanine | 4Pal |
| 3-pyridinylalanine | 3Pal |
| 2-pyridinylalanine | 2Pal |
| para-iodophenylalanine (or 4-iodophenylalanine) | pI-Phe |
| Phenylglycine | Phg |
| Propargylglycine | Pra |
| pipecolic acid | Pip |
| 4-amino-1-piperidine-4-carboxylic acid | 4Pip |
| Sarcosine | Sar |
| 1,2,3,4-tetrahydroisoquinoline | Tic |
| 1,2,3,4-tetrahydroisoquinoline-1-carboxylic acid | Tiq |
| 1,2,3,4-tetrahydroisoquinoline-7-hydroxy-3-carboxylic acid | Hydroxyl-Tic |
| 1,2,3,4-tetrahydronorharman-3 -carboxylic acid | Tpi |
| thiazolidine-4-carboxylic acid | Thz |
| 3-thienylalanine | Thi |

TABLE 3-continued

Useful non-canonical amino acids for amino acid addition, insertion, or substitution into peptide sequences in accordance with the present invention. In the event an abbreviation listed in Table 3 differs from another abbreviation for the same substance disclosed elsewhere herein, both abbreviations are understood to be applicable. The amino acids listed in Table 3 can be in the L-form or D-form, unless otherwise noted.

| Amino Acid | Abbreviation(s) |
|---|---|
| (S)-tert-butylglycine | Tle |
| symmetrical N'-ω-dimethyl arginine | SDMA |
| N-ϵ-dimethyl lysine | K(Me2) |
| 4-carboxyphenylalanine | 4CO2—F |

Nomenclature and Symbolism for Amino Acids and Peptides by the UPAC-IUB Joint Commission on Biochemical Nomenclature (JCBN) have been published in the following documents: Biochem. J., 1984, 219, 345-373; Eur. J. Biochem., 1984, 138, 9-37; 1985, 152, 1; 1993, 213, 2; Internat. J. Pept. Prot. Res., 1984, 24, following p 84; J. Biol. Chem., 1985, 260, 14-42; Pure Appl. Chem., 1984, 56, 595-624; Amino Acids and Peptides, 1985, 16, 387-410; Biochemical Nomenclature and Related Documents, 2nd edition, Portland Press, 1992, pages 39-69.

The one or more useful modifications to peptide domains of the inventive compositions can include amino acid additions or insertions, amino acid deletions, peptide truncations, amino acid substitutions, and/or chemical derivatization of amino acid residues, accomplished by known chemical techniques. For example, the thusly modified amino acid sequence includes at least one amino acid residue inserted or substituted therein, relative to the amino acid sequence of the native sequence of interest, in which the inserted or substituted amino acid residue has a side chain comprising a nucleophilic or electrophilic reactive functional group by which the peptide is covalently conjugated to a linker and/or half-life extending moiety. In accordance with the invention, useful examples of such a nucleophilic or electrophilic reactive functional group include, but are not limited to, a thiol, a primary amine, a seleno, a hydrazide, an aldehyde, a carboxylic acid, a ketone, an aminooxy, a masked (protected) aldehyde, or a masked (protected) keto functional group. Examples of amino acid residues having a side chain comprising a nucleophilic reactive functional group include, but are not limited to, a lysine residue, a homolysine, an α,β-diaminopropionic acid residue, an α,γ-diaminobutyric acid residue, an ornithine residue, a cysteine, a homocysteine, a glutamic acid residue, an aspartic acid residue, or a selenocysteine ("SeCys") residue.

Amino acid residues are commonly categorized according to different chemical and/or physical characteristics. The term "acidic amino acid residue" refers to amino acid residues in D- or L-form having side chains comprising acidic groups. Exemplary acidic residues include aspartic acid and glutamic acid residues. The term "alkyl amino acid residue" refers to amino acid residues in D- or L-form having $C_{1-6}$alkyl side chains which may be linear, branched, or cyclized, including to the amino acid amine as in proline, wherein the $C_{1-6}$alkyl is substituted by 0, 1, 2 or 3 substituents selected from $C_{1-4}$haloalkyl, halo, cyano, nitro, —C(═O)$R^b$, —C(═O)O$R^a$, —C(═O)N$R^aR^a$, —C(═N$R^a$)N$R^aR^a$, —N$R^a$C(═N$R^a$)N$R^aR^a$, —O$R^a$, —OC(═O)$R^b$, —OC(═O)N$R^aR^a$, —O$C_{2-6}$alkylN$R^aR^a$, —O$C_{2-6}$alkylO$R^a$, —S$R^a$, —S(═O)$R^b$, —S(═O)$_2R^b$, —S(═O)$_2$N$R^aR^a$, —N$R^aR^a$, —N($R^a$)C(═O)$R^b$, —N($R^a$)C(═O)O$R^b$, —N($R^a$)C(═O)N$R^aR^a$, —N($R^a$)C(═N$R^a$)N$R^aR^a$, —N($R^a$)

$S(=O)_2R^b$, $-N(R^a)S(=O)_2NR^aR^a$, $-NR^aC_{2-6}alkylNR^aR^a$ and $-NR^aC_{2-6}alkylOR^a$; wherein $R^a$ is independently, at each instance, H or $R^b$; and $R^b$ is independently, at each instance $C_{1-6}alkyl$ substituted by 0, 1, 2 or 3 substituents selected from halo, $C_{1-4}alk$, $C_{1-3}haloalk$, $-OC_{1-4}alk$, $-NH_2$, $-NHC_{1-4}alk$, and $-N(C_{1-4}alk)C_{1-4}alk$; or any protonated form thereof, including alanine, valine, leucine, isoleucine, proline, serine, threonine, lysine, arginine, histidine, aspartate, glutamate, asparagine, glutamine, cysteine, methionine, hydroxyproline, cyclohexylalanine, norleucine, norvaline, 2-aminobutyric acid, but which residues do not contain an aryl or aromatic group. The term "aromatic amino acid residue" refers to amino acid residues in D- or L-form having side chains comprising aromatic groups. Exemplary aromatic residues include tryptophan, tyrosine, 3-(1-naphthyl)alanine, histidine, or phenylalanine residues. The term "basic amino acid residue" refers to amino acid residues in D- or L-form having side chains comprising basic groups. Exemplary basic amino acid residues include histidine, lysine, homolysine, ornithine, arginine, N-methyl-arginine, ω-aminoarginine, ω-methyl-arginine, 1-methyl-histidine, 3-methyl-histidine, and homoarginine (hR) residues. The term "hydrophilic amino acid residue" refers to amino acid residues in D- or L-form having side chains comprising polar groups. Exemplary hydrophilic residues include cysteine, serine, threonine, histidine, lysine, asparagine, aspartate, glutamate, glutamine, and citrulline (Cit) residues. The terms "lipophilic amino acid residue" refers to amino acid residues in D- or L-form having sidechains comprising uncharged, aliphatic or aromatic groups. Exemplary lipophilic sidechains include phenylalanine, isoleucine, leucine, methionine, valine, tryptophan, and tyrosine. Alanine (A) is amphiphilic—it is capable of acting as a hydrophilic, or lipophilic (i.e., hydrophobic), residue. Alanine, therefore, is included within the definition of both "lipophilic" (i.e., "hydrophobic") residue and "hydrophilic" residue. The term "nonfunctional" or "neutral" amino acid residue refers to amino acid residues in D- or L-form having side chains that lack acidic, basic, or aromatic groups. Exemplary neutral amino acid residues include methionine, glycine, alanine, valine, isoleucine, leucine, and norleucine (Nle) residues.

Additional useful embodiments of toxin peptide analogs can result from conservative modifications of the amino acid sequences of the toxin polypeptides disclosed herein. Conservative modifications will produce half-life extending moiety-conjugated peptides having functional, physical, and chemical characteristics similar to those of the conjugated (e.g., PEG-conjugated) peptide from which such modifications are made. Such conservatively modified forms of the conjugated toxin peptide analogs disclosed herein are also contemplated as being an embodiment of the present invention.

In contrast, substantial modifications in the functional and/or chemical characteristics of peptides may be accomplished by selecting substitutions in the amino acid sequence that differ significantly in their effect on maintaining (a) the structure of the molecular backbone in the region of the substitution, for example, as an α-helical conformation, (b) the charge or hydrophobicity of the molecule at the target site, or (c) the size of the molecule.

For example, a "conservative amino acid substitution" may involve a substitution of a native amino acid residue with a normative residue such that there is little or no effect on the polarity or charge of the amino acid residue at that position. Furthermore, any native residue in the polypeptide may also be substituted with alanine, as has been previously described for "alanine scanning mutagenesis" (see, for example, MacLennan et al., Acta Physiol. Scand. Suppl., 643:55-67 (1998); Sasaki et al., 1998, Adv. Biophys. 35:1-24 (1998), which discuss alanine scanning mutagenesis).

In some useful embodiments of the compositions of the invention, the amino acid sequence of the toxin peptide is modified in one or more ways relative to a native toxin peptide sequence of interest, such as, but not limited to, a native GpTx-1 sequence (SEQ ID NO:1), a peptide analog of GpTx-1, or any other toxin peptides having amino acid sequences as set for in Table 5A, Table 5B, and Table 31, or elsewhere herein. The one or more useful modifications can include amino acid additions or insertions, amino acid deletions, peptide truncations, amino acid substitutions, and/or chemical derivatization of amino acid residues, accomplished by known chemical techniques. Such modifications can be, for example, for the purpose of enhanced potency, selectivity, and/or proteolytic stability, or the like. Those skilled in the art are aware of techniques for designing peptide analogs with such enhanced properties, such as alanine scanning, rational design based on alignment mediated mutagenesis using known toxin peptide sequences and/or molecular modeling.

The term "protease" is synonymous with "peptidase". Proteases comprise two groups of enzymes: the endopeptidases which cleave peptide bonds at points within the protein, and the exopeptidases, which remove one or more amino acids from either N- or C-terminus respectively. The term "proteinase" is also used as a synonym for endopeptidase. The four mechanistic classes of proteinases are: serine proteinases, cysteine proteinases, aspartic proteinases, and metallo-proteinases. In addition to these four mechanistic classes, there is a section of the enzyme nomenclature which is allocated for proteases of unidentified catalytic mechanism. This indicates that the catalytic mechanism has not been identified.

Cleavage subsite nomenclature is commonly adopted from a scheme created by Schechter and Berger (Schechter I. & Berger A., On the size of the active site in proteases. I. Papain, Biochemical and Biophysical Research Communication, 27:157 (1967); Schechter I. & Berger A., On the active site of proteases. 3. Mapping the active site of papain; specific inhibitor peptides of papain, Biochemical and Biophysical Research Communication, 32:898 (1968)). According to this model, amino acid residues in a substrate undergoing cleavage are designated P1, P2, P3, P4 etc. in the N-terminal direction from the cleaved bond. Likewise, the residues in the C-terminal direction are designated P1', P2', P3', P4', etc.

The skilled artisan is aware of a variety of tools for identifying protease binding or protease cleavage sites of interest. For example, the PeptideCutter software tool is available through the ExPASy (Expert Protein Analysis System) proteomics server of the Swiss Institute of Bioinformatics (SIB; www.expasy.org/tools/peptidecutter). PeptideCutter searches a protein sequence from the SWISS-PROT and/or TrEMBL databases or a user-entered protein sequence for protease cleavage sites. Single proteases and chemicals, a selection or the whole list of proteases and chemicals can be used. Different forms of output of the results are available: tables of cleavage sites either grouped alphabetically according to enzyme names or sequentially according to the amino acid number. A third option for output is a map of cleavage sites. The sequence and the cleavage sites mapped onto it are grouped in blocks, the size of which can be chosen by the user. Other tools are also known for determining protease cleavage sites. (E.g., Turk, B. et al., Determination of protease cleavage site motifs using mixture-based oriented peptide libraries, Nature Biotechnology, 19:661-667 (2001); Barrett A. et al., Handbook of proteolytic enzymes, Academic Press (1998)).

The serine proteinases include the chymotrypsin family, which includes mammalian protease enzymes such as chymotrypsin, trypsin or elastase or kallikrein. The serine proteinases exhibit different substrate specificities, which are related to amino acid substitutions in the various enzyme subsites interacting with the substrate residues. Some enzymes have an extended interaction site with the substrate whereas others have a specificity restricted to the P1 substrate residue.

Trypsin preferentially cleaves at R or K in position P1. A statistical study carried out by Keil (1992) described the negative influences of residues surrounding the Arg- and Lys-bonds (i.e. the positions P2 and P1', respectively) during trypsin cleavage. (Keil, B., Specificity of proteolysis, Springer-Verlag Berlin-Heidelberg-NewYork, 335 (1992)). A proline residue in position P1' normally exerts a strong negative influence on trypsin cleavage. Similarly, the positioning of R and K in P1' results in an inhibition, as well as negatively charged residues in positions P2 and P1'.

Chymotrypsin preferentially cleaves at a W, Y or F in position P1 (high specificity) and to a lesser extent at L, M or H residue in position P1. (Keil, 1992). Exceptions to these rules are the following: When W is found in position P1, the cleavage is blocked when M or P are found in position P1' at the same time. Furthermore, a proline residue in position P1' nearly fully blocks the cleavage independent of the amino acids found in position P1. When an M residue is found in position P1, the cleavage is blocked by the presence of a Y residue in position P1'. Finally, when H is located in position P1, the presence of a D, M or W residue also blocks the cleavage.

Membrane metallo-endopeptidase (NEP; neutral endopeptidase, kidney-brush-border neutral proteinase, enkephalinase, EC 3.4.24.11) cleaves peptides at the amino side of hydrophobic amino acid residues. (Connelly, J C et al., Neutral Endopeptidase 24.11 in Human Neutrophils: Cleavage of Chemotactic Peptide, PNAS, 82(24):8737-8741 (1985)).

Thrombin preferentially cleaves at an R residue in position P1. (Keil, 1992). The natural substrate of thrombin is fibrinogen. Optimum cleavage sites are when an R residue is in position P1 and Gly is in position P2 and position P1'. Likewise, when hydrophobic amino acid residues are found in position P4 and position P3, a proline residue in position P2, an R residue in position P1, and non-acidic amino acid residues in position P1' and position P2'. A very important residue for its natural substrate fibrinogen is a D residue in P10.

Caspases are a family of cysteine proteases bearing an active site with a conserved amino acid sequence and which cleave peptides specifically following D residues. (Earnshaw W C et al., Mammalian caspases: Structure, activation, substrates, and functions during apoptosis, Annual Review of Biochemistry, 68:383-424 (1999)).

The Arg-C proteinase preferentially cleaves at an R residue in position P1. The cleavage behavior seems to be only moderately affected by residues in position P1'. (Keil, 1992). The Asp-N endopeptidase cleaves specifically bonds with a D residue in position P1'. (Keil, 1992).

The foregoing is merely exemplary and by no means an exhaustive treatment of knowledge available to the skilled artisan concerning protease binding and/or cleavage sites that the skilled artisan may be interested in eliminating in practicing the invention.

Desired amino acid substitutions (whether conservative or non-conservative) can be determined by those skilled in the art at the time such substitutions are desired. For example, amino acid substitutions can be used to identify important residues of the peptide sequence, or to increase or decrease the affinity of the peptide or vehicle-conjugated peptide molecules described herein.

Naturally occurring residues may be divided into classes based on common side chain properties:

1) hydrophobic: norleucine (Nor or Nle), Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of these classes for a member from another class. Such substituted residues may be introduced into regions of the toxin peptide analog.

In making such changes, according to certain embodiments, the hydropathic index of amino acids may be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art (see, for example, Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those that are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as disclosed herein. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those that are within ±1 are included, and in certain embodiments, those within ±0.5 are included. One may also identify epitopes from primary amino acid sequences on the basis of hydrophilicity. These regions are also referred to as "epitopic core regions."

Examples of conservative substitutions include the substitution of one non-polar (hydrophobic) amino acid residue such as isoleucine, valine, leucine norleucine, alanine, or methionine for another, the substitution of one polar (hydrophilic) amino acid residue for another such as between arginine and lysine, between glutamine and asparagine, between glycine and serine, the substitution of one basic amino acid residue such as lysine, arginine or histidine for another, or the substitution of one acidic residue, such as aspartic acid or glutamic acid for another. The phrase "conservative amino acid substitution" also includes the use of a chemically derivatized residue in place of a non-derivatized residue, provided that such polypeptide displays the requisite bioactivity. Other exemplary amino acid substitutions that can be useful in accordance with the present invention are set forth in Table 4 below.

TABLE 4

Some Useful Amino Acid Substitutions.

| Original Residues | Exemplary Substitutions |
|---|---|
| Ala | Val, Leu, Ile, Gly |
| Arg | Lys, Gln, Asn, His |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala, Phe, Norleucine |
| Leu | Norleucine, Ile, Val, Met, Ala, Phe |
| Lys | Arg, 1,4-Diamino-butyric Acid, Gln, Asn, His |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala, Norleucine |

By way of illustration, in embodiments of the present invention directed to a composition of matter comprising an isolated polypeptide comprising the amino acid sequence of the formula:

SEQ ID NO: 475

$X_{aa}{}^{1}X_{aa}{}^{2}X_{aa}{}^{3}X_{aa}{}^{4}X_{aa}{}^{5}X_{aa}{}^{6}X_{aa}{}^{7}X_{aa}{}^{8}X_{aa}{}^{9}X_{aa}{}^{10}X_{aa}{}^{11}$ $X_{aa}{}^{12}X_{aa}{}^{13}X_{aa}{}^{14}\text{Asp}^{15}X_{aa}{}^{16}X_{aa}{}^{17}X_{aa}{}^{18}X_{aa}{}^{19}X_{aa}{}^{20}X_{aa}{}^{21}$ $X_{aa}{}^{22}X_{aa}{}^{23}X_{aa}{}^{24}X_{aa}{}^{25}X_{aa}{}^{26}X_{aa}{}^{27}X_{aa}{}^{28}X_{aa}{}^{29}X_{aa}{}^{30}X_{aa}{}^{31}$ $\text{Lys}^{32}X_{aa}{}^{33}X_{aa}{}^{34}X_{aa}{}^{35}X_{aa}{}^{36}X_{aa}{}^{37}X_{aa}{}^{38}$// or a pharmaceutically acceptable salt thereof, wherein:

$X_{aa}{}^{1}X_{aa}{}^{2}$ is absent; or $X_{aa}{}^{1}$ is any amino acid residue and $X_{aa}{}^{2}$ is any amino acid residue; or $X_{aa}{}^{1}$ is absent and $X_{aa}{}^{2}$ is any amino acid residue;

$X_{aa}{}^{3}$ is Cys, if $X_{aa}{}^{18}$ is Cys; or $X_{aa}{}^{3}$ is SeCys, if $X_{aa}{}^{18}$ is SeCys; or $X_{aa}{}^{3}$ is an alkyl amino acid residue, if $X_{aa}{}^{18}$ is an alkyl amino acid residue (for example, $X_{aa}{}^{3}$ and $X_{aa}{}^{18}$ can be, independently, Ala or 2-Abu residues);

$X_{aa}{}^{4}$ is an acidic, hydrophobic, basic, or neutral hydrophilic amino acid residue (e.g., $X_{aa}{}^{4}$ can be selected from Ala, Glu, Asp, phosphoserine, phosphotyrosine, gamma-carboxy-glutamic acid, Phe, Pro, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues);

$X_{aa}{}^{5}$ is a Gly, Ala, hydrophobic, or basic amino acid residue (e.g., $X_{aa}{}^{5}$ can be selected from Ala, Phe, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues);

$X_{aa}{}^{6}$ is a Gly, Ala, 2-Abu, norleucine (Nle), norvaline (Nva), or hydrophobic amino acid residue (e.g., $X_{aa}{}^{6}$ can be selected from Ala, Phe, Ile, Leu, Met, Val, Trp, Tyr, proline, thiaproline, methionine, glycine, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues);

$X_{aa}{}^{7}$ is a Gly, Ala, aromatic, or hydrophobic amino acid residue (e.g., $X_{aa}{}^{7}$ can be selected from Gly, Ala, Phe, Ile, Leu, Met, Val, Trp, Tyr, Pro, 2-pyridinylalanine, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues);

$X_{aa}{}^{8}$ is a basic, acidic, or neutral hydrophilic amino acid residue, or an Ala residue (e.g., $X_{aa}{}^{8}$ can be selected from Ala, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Ser, Thr, Asn, Gln, Cit, phosphoserine, phosphotyrosine, gamma-carboxyglutamic acid, Asp, and Glu residues);

$X_{aa}{}^{9}$ is a basic or neutral hydrophilic amino acid residue (e.g., $X_{aa}{}^{9}$ can be selected from Ala, Pro, Met, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues);

$X_{aa}{}^{10}$ is Cys if $X_{aa}{}^{24}$ is Cys; or $X_{aa}{}^{10}$ is SeCys if $X_{aa}{}^{24}$ is SeCys;

$X_{aa}{}^{11}$ is any amino acid residue (e.g., $X_{aa}{}^{11}$ can be selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues);

$X_{aa}^{12}$ is a Pro, acidic, neutral, or hydrophobic amino acid residue (e.g., $X_{aa}^{12}$ can be selected from alanine, valine, leucine, isoleucine, proline, serine, threonine, aspartic acid, glutamatic acid, glycine, norleucine, norvaline, 1-Nal, 2-Nal, 1'NMe-Trp, Cha, and 4-phenyl-phenylalanine (Bip), cyclohexylglycine (Chg), cyclohexylalanine (Cha), asparagine, glutamine, methionine, hydroxyproline, phenylalanine, tryptophan, and tyrosine);

$X_{aa}^{13}$ is any amino acid residue (e.g., $X_{aa}^{13}$ can be selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues);

$X_{aa}^{14}$ is any amino acid residue (e.g., $X_{aa}^{14}$ can be selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues);

$X_{aa}^{16}$ is a basic, neutral hydrophilic, or acidic amino acid residue, or an Ala residue (e.g., $X_{aa}^{16}$ can be selected from Ala, Pro, Met, Arg, Lys, His, Pra, Atz, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, Cit, phosphoserine, phosphotyrosine, gamma-carboxy-glutamic acid, Asp, and Glu residues);

$X_{aa}^{17}$ is a Cys if $X_{aa}^{31}$ is Cys; or $X_{aa}^{17}$ is a SeCys if $X_{aa}^{31}$ is SeCys;

$X_{aa}^{18}$ is a Cys, SeCys, or an alkyl amino acid residue;

$X_{aa}^{19}$ is any amino acid residue (e.g., $X_{aa}^{19}$ can be selected from Ala, Asp, Glu, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues);

$X_{aa}^{20}$ is a Pro, Gly, basic, or neutral hydrophilic residue (e.g., $X_{aa}^{20}$ can be selected from Ala, Pro, Met, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues);

$X_{aa}^{21}$ is a basic, hydrophobic, or neutral hydrophilic amino acid residue (e.g., $X_{aa}^{21}$ can be selected from Ala, Phe, Pro, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues);

$X_{aa}^{22}$ is a hydrophobic or basic amino acid residue (e.g., $X_{aa}^{22}$ can be selected from Ala, Phe, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues);

$X_{aa}^{23}$ is a hydrophobic, basic, or neutral hydrophilic amino acid residue (e.g., $X_{aa}^{23}$ can be selected from Ala, Phe, Pro, Ile, Leu, Met, Val, Trp, Tyr, Arg, Lys, His, Pra, Atz, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues);

$X_{aa}^{24}$ is a Cys or SeCys residue;

$X_{aa}^{25}$ is a Ser, Ala, or a neutral hydrophilic amino acid residue (e.g., $X_{aa}^{25}$ is selected from Ala, Gly, Pro, Met, glycine, Gln, Asn, Ser, Thr, and Cit residues);

$X_{aa}^{26}$ is an Ala, acidic, basic, or neutral hydrophilic amino acid residue (e.g., $X_{aa}^{26}$ can be selected from Ala, Pro, Met, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, Asp, Glu, phosphoserine, phosphotyrosine, gamma-carboxyglutamic acid, Gln, Asn, Ser, Thr, and Cit residues);

$X_{aa}^{27}$ is an acidic, basic, neutral hydrophilic, or hydrophobic residue (e.g., $X_{aa}^{27}$ can be selected from Thr, Leu, Ile, Val, Ser, Met, Gln, Asn, Phe, Tyr, Trp, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Asp, Glu, phosphoserine, phosphotyrosine, gamma-carboxy-glutamic acid, cyclohexylglycine (Chg), cyclohexylalanine (Cha), norleucine, norvaline, 1-Nal, 2-Nal, 4-phenyl-phenylalanine (Bip), Glu, Asp, and Gly residues);

$X_{aa}^{28}$ is an aromatic or basic amino acid residue (e.g., $X_{aa}^{28}$ can be selected from Phe, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, 1-Nal, 2-Nal, 2-pyridyl-alanine, 3-pyridyl-alanine, 4-pyridyl-alanine, 4-piperidinyl-alanine, and 4-phenyl-phenylalanine (Bip) residues);

$X_{aa}^{29}$ is an acidic, basic, or neutral hydrophilic amino acid residue (e.g., $X_{aa}^{29}$ can be selected from Ala, Asp, Glu, phosphoserine, phosphotyrosine, gamma-carboxyglutamic acid, Phe, Gly, His, Lys, Asn, Pro, Gln, Arg, Ser, Thr, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, and Dab residues). In some useful embodiment $X_{aa}^{29}$ is an acidic or neutral hydrophilic residue (e.g., an Ala, Asp, Glu, Gly, Asn, Gln, Ser, Thr, phosphoserine, phosphotyrosine, or gamma-carboxyglutamic acid residue [e.g., SEQ ID NOS: 1071-2798]);

$X_{aa}^{30}$ is a Trp, 5-bromoTrp, 6-bromoTrp, 5-chloroTrp, 6-chloroTrp, 1-Nal, 2-Nal, or thioTrp residue;

$X_{aa}^{31}$ is a Cys or SeCys;

$X_{aa}^{33}$ is a hydrophobic or aromatic amino acid residue (e.g., $X_{aa}^{33}$ can be selected from Phe, Ile, Leu, Met, Val, Trp, Tyr, norleucine, norvaline, 1-Nal, 2-Nal, 2-pyridyl-alanine, 3-pyridyl-alanine, 4-pyridyl-alanine, 4-piperidinyl-alanine, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues);

$X_{aa}^{34}$ is any amino acid residue (e.g., $X_{aa}^{34}$ can be selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, 2-pyridyl-alanine, 3-pyridyl-alanine, 4-carboxy-phenylalanine, and 4-phenyl-phenylalanine (Bip) residues);

$X_{aa}^{35}$ is a hydrophobic amino acid residue (e.g., $X_{aa}^{35}$ can be selected from Phe, Ile, Leu, Met, Val, Trp, Tyr, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues);

each of $X_{aa}^{36}$, $X_{aa}^{37}$, and $X_{aa}^{38}$ is independently absent or is independently a neutral, basic, or hydrophobic amino acid residue (e.g., each of $X_{aa}^{36}$, $X_{aa}^{37}$, and $X_{aa}^{38}$ can be independently absent or independently selected from Ala, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues); and wherein:

if $X_{aa}^{3}$ and $X_{aa}^{18}$ are both Cys residues, there is a disulfide bond between residue $X_{aa}^{3}$ and residue $X_{aa}^{18}$; or if $X_{aa}^{3}$ and $X_{aa}^{18}$ are both SeCys residues, there is a diselenide bond between residue $X_{aa}^{3}$ and residue $X_{aa}^{18}$;

if $X_{aa}^{10}$ and $X_{aa}^{24}$ are both Cys residues, there is a disulfide bond between residue $X_{aa}^{10}$ and residue $X_{aa}^{24}$; or if $X_{aa}^{10}$ and $X_{aa}^{24}$ are both SeCys residues, there is a diselenide bond between residue $X_{aa}^{10}$ and residue $X_{aa}^{24}$;

if $X_{aa}^{17}$ and $X_{aa}^{31}$ are both Cys residues, there is a disulfide bond between residue $X_{aa}^{17}$ and residue $X_{aa}^{31}$; or if $X_{aa}^{17}$ and $X_{aa}^{31}$ are both SeCys residues, there is a diselenide bond between residue $X_{aa}^{17}$ and residue $X_{aa}^{31}$;

the amino-terminal residue is optionally acetylated, biotinylated, 4-pentynoylated, or PEGylated; and the carboxy-terminal residue is optionally amidated. Many particular examples of such C-terminally amidated appear in Table 5A and Table 5B.

Another example of the inventive composition described immediately above (SEQ ID NO:475) is the composition of matter wherein the isolated polypeptide comprises the amino acid sequence of the formula:

$X_{aa}{}^{1}X_{aa}{}^{2}$Cys3$X_{aa}{}^{4}X_{aa}{}^{5}$Ala$^{6}X_{aa}{}^{7}X_{aa}{}^{8}X_{aa}{}^{9}$Cys$^{10}X_{aa}{}^{11}X_{aa}{}^{12}X_{aa}{}^{13}X_{aa}{}^{14}$Asp$^{15}X_{aa}{}^{16}$Cys$^{17}$Cys$^{18}X_{aa}{}^{19}X_{aa}{}^{20}X_{aa}{}^{21}X_{aa}{}^{22}X_{aa}{}^{23}$Cys$^{24}X_{aa}{}^{25}X_{aa}{}^{26}X_{aa}{}^{27}X_{aa}{}^{28}X_{aa}{}^{29}X_{aa}{}^{30}$CyS$^{31}$Lys$^{32}X_{aa}{}^{33}X_{aa}{}^{34}X_{aa}{}^{35}X_{aa}{}^{36}X_{aa}{}^{37}X_{aa}{}^{38}$//SEQ ID NO:476, and the variable positions of SEQ ID NO:476 are exemplified as in the immediately preceding paragraphs concerning the variable positions of SEQ ID NO:475. Particularly useful embodiments of the composition of matter comprise an Ala, Gly, 2-Abu, Nle, or Nva residue at position $X_{aa}^{6}$ of SEQ ID NO:475, with some of these embodiments also having a Glu residue at position $X_{aa}^{27}$ of SEQ ID NO:475, for example, [Ala5, Glu26]GpTx-1, [Gly5, Glu26]GpTx-1, [2-Abu5, Glu26]GpTx-1, [Nle5, Glu26]GpTx-1, or [Nva5, Glu26] GpTx-1 peptide analogs, which, optionally, can also have additional substituted amino acid residues at other amino acid positions and/or additional residues at the N-terminal and/or C-terminal end. Other useful examples comprise an Asp, Glu, or Gln residue at position $X_{aa}^{29}$ of SEQ ID NO: 475 or $X_{aa}^{29}$ of SEQ ID NO:476, with or without a Glu residue at position $X_{aa}^{27}$ of SEQ ID NO:475, e.g., [Ala5, Asp28]GpTx-1, [Ala5, Glu28]GpTx-1, [Ala5, Gln28]GpTx-1, [Ala5, Glu26, Asp28] GpTx-1, [Ala5, Glu26, Glu28]GpTx-1, [Ala5, Glu26, Gln28] GpTx-1, [Gly5, Asp28]GpTx-1, [Gly5, Glu28]GpTx-1, [Gly5, Gln28]GpTx-1, [Gly5, Glu26, Asp28]GpTx-1, [Gly5, Glu26, Glu28]GpTx-1, [Gly5, Glu26, Gln28]GpTx-1, [2-Abu5, Asp28]GpTx-1, [2-Abu5, Glu28]GpTx-1, [2-Abu5, Gln28]GpTx-1, [2-Abu5, Glu26, Asp28]GpTx-1, [2-Abu5, Glu26, Glu28]GpTx-1, [2-Abu5, Glu26, Gln28] GpTx-1, [Nle5, Asp28]GpTx-1, [Nle5, Glu28]GpTx-1, [Nle5, Gln28]GpTx-1, [Nle5, Glu26, Asp28]GpTx-1, [Nle5, Glu26, Glu28]GpTx-1, and [Nle5, Glu26, Gln28]GpTx-1, [Nva5, Asp28]GpTx-1, [Nva5, Glu28]GpTx-1, [Nva5, Gln28]GpTx-1, [Nva5, Glu26, Asp28]GpTx-1, [Nva5, Glu26, Glu28]GpTx-1, and [Nva5, Glu26, Gln28]GpTx-1.

Some examples of the composition of matter comprising an amino acid sequence that comprises an Ala residue at position $X_{aa}^{6}$ of SEQ ID NO:475 include: SEQ ID NOS: 22, 252-263, 419-439, 518-521, 524, 525, 562-580, 602, 691, 692, 696-703, 715, 721-735, 737-749, 756, 757, 761, 762, 764-771, 787-796, 798, 800, 802, 803, 809-812, 1028, 1030-1040, 1043-1047, 1062-1065, 1068-1070, 1082, 1096, 1110, 1124, 1135, 1146, 1157, 1165, 1173, 1181, 1192, 1203, 1214, 1222, 1230, 1238, 1249, 1260, 1271, 1279, 1287, 1295, 1306, 1317, 1328, 1336, 1344, 1352, 1360, 1368, 1376, 1384, 1392, 1400, 1408, 1416, 1424, 1432, 1440, 1448, 1456, 1464, 1472, 1480, 1488, 1496, 1504, 1512, 1520, 1528, 1536, 1544, 1552, 1560, 1568, 1576, 1584, 1592, 1600, 1608, 1616, 1624, 1632, 1640, 1658, 1672, 1686, 1700, 1711, 1722, 1733, 1741, 1749, 1757, 1768, 1779, 1790, 1798, 1806, 1814, 1825, 1836, 1847, 1855, 1863, 1871, 1882, 1893, 1904, 1912, 1920, 1928, 1936, 1944, 1952, 1960, 1968, 1976, 1984, 1992, 2000, 2008, 2016, 2024, 2032, 2040, 2048, 2056, 2064, 2072, 2080, 2088, 2096, 2104, 2112, 2120, 2128, 2136, 2144, 2152, 2160, 2168, 2176, 2184, 2192, 2200, 2208, 2216, 2234, 2248, 2262, 2276, 2287, 2298, 2309, 2317, 2325, 2333, 2344, 2355, 2366, 2374, 2382, 2390, 2401, 2412, 2423, 2431, 2439, 2447, 2458, 2469, 2480, 2488, 2496, 2504, 2512, 2520, 2528, 2536, 2544, 2552, 2560, 2568, 2576, 2584, 2592, 2600, 2608, 2616, 2624, 2632, 2640, 2648, 2656, 2664, 2672, 2680, 2688, 2696, 2704, 2712, 2720, 2728, 2736, 2744, 2752, 2760, 2768, 2776, 2784, 2792, 2808, 2822, 2833, 2844, 2855, 2863, 2871, 2879, 2890, 2901, 2912, 2920, 2928, 2936, 2944, 2952, 2960, 2968, 2976, 2984, 2992, 3000, 3008, 3016, 3024, 3032, 3040, 3048, 3056, 3064, 3072, and 3080, as set forth in Table 5A and Table 5B. Other examples comprise a free acid at the C-terminal (rather than an amidated C-terminal residue) of any of the foregoing, such as SEQ ID NOS: 597-601 and 813-1027, as set forth in Table 5A and Table 5B.

Some examples of the composition of matter comprising an amino acid sequence that comprises a Gly residue at position $X_{aa}^{6}$ of SEQ ID NO:475 include: SEQ ID NOS: 265, 751, 752, 754, 755, 1081, 1095, 1109, 1123, 1134, 1145, 1156, 1164, 1172, 1180, 1191, 1202, 1213, 1221, 1229, 1237, 1248, 1259, 1270, 1278, 1286, 1294, 1305, 1316, 1327, 1335, 1343, 1351, 1359, 1367, 1375, 1383, 1391, 1399, 1407, 1415, 1423, 1431, 1439, 1447, 1455, 1463, 1471, 1479, 1487, 1495, 1503, 1511, 1519, 1527, 1535, 1543, 1551, 1559, 1567, 1575, 1583, 1591, 1599, 1607, 1615, 1623, 1631, 1639, 1657, 1671, 1685, 1699, 1710, 1721, 1732, 1740, 1748, 1756, 1767, 1778, 1789, 1797, 1805, 1813, 1824, 1835, 1846, 1854, 1862, 1870, 1881, 1892, 1903, 1911, 1919, 1927, 1935, 1943, 1951, 1959, 1967, 1975, 1983, 1991, 1999, 2007, 2015, 2023, 2031, 2039, 2047, 2055, 2063, 2071, 2079, 2087, 2095, 2103, 2111, 2119, 2127, 2135, 2143, 2151, 2159, 2167, 2175, 2183, 2191, 2199, 2207, 2215, 2233, 2247, 2261, 2275, 2286, 2297, 2308, 2316, 2324, 2332, 2343, 2354, 2365, 2373, 2381, 2389, 2400, 2411, 2422, 2430, 2438, 2446, 2457, 2468, 2479, 2487, 2495, 2503, 2511, 2519, 2527, 2535, 2543, 2551, 2559, 2567, 2575, 2583, 2591, 2599, 2607, 2615, 2623, 2631, 2639, 2647, 2655, 2663, 2671, 2679, 2687, 2695, 2703, 2711, 2719, 2727, 2735, 2743, 2751, 2759, 2767, 2775, 2783, 2791, 2807, 2821, 2832, 2843, 2854, 2862, 2870, 2878, 2889, 2900, 2911, 2919, 2927, 2935, 2943, 2951, 2959, 2967, 2975, 2983, 2991, 2999, 3007, 3015, 3023, 3031, 3039, 3047, 3055, 3063, 3071, and 3079, as set forth in Table 5A and Table 5B.

Some examples of the composition of matter comprising an amino acid sequence that comprises a 2-Abu residue at position $X_{aa}^{6}$ of SEQ ID NO:475 include: SEQ ID NOS: 605, 636, 649, 706, 707, 718, 753, 758, 797, 799, 801, 804, 807, 808, 1029, 1041, 1042, 1048, 1066, 1067, 1083, 1097, 1111, 1125, 1136, 1147, 1158, 1166, 1174, 1182, 1193, 1204, 1215, 1223, 1231, 1239, 1250, 1261, 1272, 1280, 1288, 1296, 1307, 1318, 1329, 1337, 1345, 1353, 1361, 1369, 1377, 1385, 1393, 1401, 1409, 1417, 1425, 1433, 1441, 1449, 1457, 1465, 1473, 1481, 1489, 1497, 1505, 1513, 1521, 1529, 1537, 1545, 1553, 1561, 1569, 1577, 1585, 1593, 1601, 1609, 1617, 1625, 1633, 1641, 1659, 1673, 1687, 1701, 1712, 1723, 1734, 1742, 1750, 1758, 1769, 1780, 1791, 1799, 1807, 1815, 1826, 1837, 1848, 1856, 1864, 1872, 1883, 1894, 1905, 1913, 1921, 1929, 1937, 1945, 1953, 1961, 1969, 1977, 1985, 1993, 2001, 2009, 2017, 2025, 2033, 2041, 2049, 2057, 2065, 2073, 2081, 2089, 2097, 2105, 2113, 2121, 2129, 2137, 2145, 2153, 2161, 2169, 2177, 2185, 2193, 2201, 2209, 2217, 2235, 2249, 2263, 2277, 2288, 2299, 2310, 2318, 2326, 2334, 2345, 2356, 2367, 2375, 2383, 2391, 2402, 2413, 2424, 2432, 2440, 2448, 2459, 2470, 2481, 2489, 2497, 2505, 2513, 2521, 2529, 2537, 2545, 2553, 2561, 2569, 2577, 2585, 2593, 2601, 2609, 2617, 2625, 2633, 2641, 2649, 2657, 2665, 2673, 2681, 2689, 2697, 2705, 2713, 2721, 2729, 2737, 2745, 2753, 2761, 2769, 2777, 2785, 2793, 2809, 2823, 2834, 2845, 2856, 2864, 2872, 2880, 2891, 2902, 2913, 2921, 2929, 2937, 2945, 2953, 2961, 2969, 2977, 2985, 2993, 3001, 3009, 3017, 3025, 3033, 3041, 3049, 3057, 3065, 3073, and 3081, as set forth in Table 5A and Table 5B.

Some examples of the composition of matter comprising an amino acid sequence that comprises a Nle residue at position $X_{aa}^{6}$ of SEQ ID NO:475 include: SEQ ID NOS: 607, 638, 651, 1085, 1099, 1113, 1127, 1138, 1149, 1160, 1168, 1176, 1184, 1195, 1206, 1217, 1225, 1233, 1241, 1252, 1263, 1274, 1282, 1290, 1298, 1309, 1320, 1331, 1339, 1347, 1355, 1363, 1371, 1379, 1387, 1395, 1403, 1411, 1419, 1427, 1435, 1443, 1451, 1459, 1467, 1475, 1483, 1491, 1499, 1507, 1515, 1523, 1531, 1539, 1547, 1555, 1563, 1571, 1579, 1587, 1595, 1603, 1611, 1619, 1627, 1635, 1643, 1661, 1675, 1689, 1703, 1714, 1725, 1736, 1744, 1752, 1760, 1771, 1782, 1793, 1801, 1809, 1817, 1828, 1839, 1850, 1858, 1866, 1874, 1885, 1896, 1907, 1915, 1923, 1931, 1939, 1947, 1955, 1963, 1971, 1979, 1987, 1995, 2003, 2011, 2019, 2027, 2035, 2043, 2051, 2059, 2067, 2075, 2083, 2091, 2099, 2107, 2115, 2123, 2131, 2139, 2147, 2155, 2163, 2171, 2179, 2187, 2195, 2203, 2211, 2219, 2237, 2251, 2265, 2279, 2290, 2301, 2312, 2320, 2328, 2336, 2347, 2358, 2369, 2377, 2385, 2393, 2404, 2415, 2426, 2434, 2442, 2450, 2461, 2472, 2483, 2491, 2499, 2507, 2515, 2523, 2531, 2539, 2547, 2555, 2563, 2571, 2579, 2587, 2595, 2603, 2611, 2619, 2627, 2635, 2643, 2651, 2659, 2667, 2675, 2683, 2691, 2699, 2707, 2715, 2723, 2731, 2739, 2747, 2755, 2763, 2771, 2779, 2787, 2795, 2811, 2825, 2836, 2847, 2858, 2866, 2874, 2882, 2893, 2904, 2915, 2923, 2931, 2939, 2947, 2955, 2963, 2971, 2979, 2987, 2995, 3003, 3011, 3019, 3027, 3035, 3043, 3051, 3059, 3067, 3075, and 3083, as set forth in Table 5A and Table 5B.

Some examples of the composition of matter comprising an amino acid sequence that comprises a Nva residue at position $X_{aa}^{6}$ of SEQ ID NO:475 include: SEQ ID NOS: 606, 637, 650, 705, 708, 717, 759, 760, 805, 806, 1084, 1098, 1112, 1126, 1137, 1148, 1159, 1167, 1175, 1183, 1194, 1205, 1216, 1224, 1232, 1240, 1251, 1262, 1273, 1281, 1289, 1297, 1308, 1319, 1330, 1338, 1346, 1354, 1362, 1370, 1378, 1386, 1394, 1402, 1410, 1418, 1426, 1434, 1442, 1450, 1458, 1466, 1474, 1482, 1490, 1498, 1506, 1514, 1522, 1530, 1538, 1546, 1554, 1562, 1570, 1578, 1586, 1594, 1602, 1610, 1618, 1626, 1634, 1642, 1660, 1674, 1688, 1702, 1713, 1724, 1735, 1743, 1751, 1759, 1770, 1781, 1792, 1800, 1808, 1816, 1827, 1838, 1849, 1857, 1865, 1873, 1884, 1895, 1906, 1914, 1922, 1930, 1938, 1946, 1954, 1962, 1970, 1978, 1986, 1994, 2002, 2010, 2018, 2026, 2034, 2042, 2050, 2058, 2066, 2074, 2082, 2090, 2098, 2106, 2114, 2122, 2130, 2138, 2146, 2154, 2162, 2170, 2178, 2186, 2194, 2202, 2210, 2218, 2236, 2250, 2264, 2278, 2289, 2300, 2311, 2319, 2327, 2335, 2346, 2357, 2368, 2376, 2384, 2392, 2403, 2414, 2425, 2433, 2441, 2449, 2460, 2471, 2482, 2490, 2498, 2506, 2514, 2522, 2530, 2538, 2546, 2554, 2562, 2570, 2578, 2586, 2594, 2602, 2610, 2618, 2626, 2634, 2642, 2650, 2658, 2666, 2674, 2682, 2690, 2698, 2706, 2714, 2722, 2730, 2738, 2746, 2754, 2762, 2770, 2778, 2786, 2794, 2810, 2824, 2835, 2846, 2857, 2865, 2873, 2881, 2892, 2903, 2914, 2922, 2930, 2938, 2946, 2954, 2962, 2970, 2978, 2986, 2994, 3002, 3010, 3018, 3026, 3034, 3042, 3050, 3058, 3066, 3074, and 3082, as set forth in Table 5A and Table 5B.

Other exemplary embodiments of the inventive composition are unconjugated and conjugated peptide analogs of GpTx-1 having one of the amino acid sequences as set forth in Table 5A, Table 5B, and Table 31. Particular embodiments of the inventive isolated polypeptides include those having an amino acid sequence selected from SEQ ID NOS: 3-134, 136-305, 307-386, 388-474, 515-527, 532-588, 590, 591, 593-1049, and 1062-3086, and more particularly an amino acid sequence selected from SEQ ID NOS: 3-30, 32-72, 74-134, 136-178, 180-211, 218-239, 241-305, 307-363, 366-386, 388-432, 434-474, 515-527, 532-588, 590, 591, 593-775, 777, 778, 780-788, 790-1049, and 1062-3086. Any of these further comprising an optional linker moiety and a pharmaceutically acceptable, covalently linked half-life extending moiety, as described herein, are also encompassed within the present invention. A pharmaceutical composition comprising any of these polypeptides (with or without a covalently linked half-life extending moiety) and a pharmaceutically acceptable carrier is also encompassed within the present invention.

TABLE 5A

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| GpTx-1(1-34) | {H}-DCLGFMRKCIPDNDKCCRPNLVCSRTHKWCKYVF-{Amide} | 1 |
| [All D-isomer]GpTx-1(1-34) | {H}-dclgfmrkcipdndkccrpnlvcsrthkwckyvf-{Amide} | 2 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [SeMet6]GpTx-1(1-34) | {H}-DCLGF[SeMet]RKCIPDNDKCCRPNLVCSRTHKWCKYVF-{Amide} | 3 |
| [Ala12]GpTx-1(1-34) | {H}-DCLGFMRKCIPANDKCCRPNLVCSRTHKWCKYVF-{Amide} | 4 |
| [Ala13]GpTx-1(1-34) | {H}-DCLGFMRKCIPDADKCCRPNLVCSRTHKWCKYVF-{Amide} | 5 |
| [Ala15]GpTx-1(1-34) | {H}-DCLGFMRKCIPDNDACCRPNLVCSRTHKWCKYVF-{Amide} | 6 |
| [Ala20]GpTx-1(1-34) | {H}-DCLGFMRKCIPDNDKCCRPALVCSRTHKWCKYVF-{Amide} | 7 |
| [Ala22]GpTx-1(1-34) | {H}-DCLGFMRKCIPDNDKCCRPNLACSRTHKWCKYVF-{Amide} | 8 |
| [Ala25]GpTx-1(1-34) | {H}-DCLGFMRKCIPDNDKCCRPNLVCSATHKWCKYVF-{Amide} | 9 |
| [Ala26]GpTx-1(1-34) | {H}-DCLGFMRKCIPDNDKCCRPNLVCSRAHKWCKYVF-{Amide} | 10 |
| [Ala27]GpTx-1(1-34) | {H}-DCLGFMRKCIPDNDKCCRPNLVCSRTAKWCKYVF-{Amide} | 11 |
| [Ala28]GpTx-1(1-34) | {H}-DCLGFMRKCIPDNDKCCRPNLVCSRTHAWCKYVF-{Amide} | 12 |
| [Ala31]GpTx-1(1-34) | {H}-DCLGFMRKCIPDNDKCCRPNLVCSRTHKWCAYVF-{Amide} | 13 |
| [Ala32]GpTx-1(1-34) | {H}-DCLGFMRKCIPDNDKCCRPNLVCSRTHKWCKAVF-{Amide} | 14 |
| [Ala33]GpTx-1(1-34) | {H}-DCLGFMRKCIPDNDKCCRPNLVCSRTHKWCKYAF-{Amide} | 15 |
| GpTx-1(1-34)-Ala | {H}-DCLGFMRKCIPDNDKCCRPNLVCSRTHKWCKYVFA-{Amide} | 16 |
| Glu-GpTx-1(1-34) | {H}-EDCLGFMRKCIPDNDKCCRPNLVCSRTHKWCKYVF-{Amide} | 17 |
| [Glu1]GpTx-1(1-34) | {H}-ECLGFMRKCIPDN DKCCRPNLVCSRTHKWCKYVF-{Amide} | 18 |
| [Glu3]GpTx-1(1-34) | {H}-DCEGFMRKCIPDNDKCCRPNLVCSRTHKWCKYVF-{Amide} | 19 |
| [Ala1]GpTx-1(1-34) | {H}-ACLGFMRKCIPDN DKCCRPNLVCSRTHKWCKYVF-{Amide} | 20 |
| [Ala3]GpTx-1(1-34) | {H}-DCAGFMRKCIPDNDKCCRPNLVCSRTHKWCKYVF-{Amide} | 21 |
| [Ala5]GpTx-1(1-34) | {H}-DCLGAMRKCIPDNDKCCRPNLVCSRTHKWCKYVF-{Amide} | 22 |
| [Ala6]GpTx-1(1-34) | {H}-DCLGFARKCIPDNDKCCRPNLVCSRTHKWCKYVF-{Amide} | 23 |
| [Glu4]GpTx-1(1-34) | {H}-DCLEFMRKCIPDNDKCCRPNLVCSRTHKWCKYVF-{Amide} | 24 |
| [Glu8]GpTx-1(1-34) | {H}-DCLGFMRECIPDNDKCCRPNLVCSRTHKWCKYVF-{Amide} | 25 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Glu12]GpTx-1(1-34) | {H}-DCLGFMRKCIPENDKCCRPNLVCSRTHKWCKYVF-{Amide} | 26 |
| [Glu13]GpTx-1(1-34) | {H}-DCLGFMRKCIPDEDKCCRPNLVCSRTHKWCKYVF-{Amide} | 27 |
| [Glu15]GpTx-1(1-34) | {H}-DCLGFMRKCIPDNDECCRPNLVCSRTHKWCKYVF-{Amide} | 28 |
| [Glu27]GpTx-1(1-34) | {H}-DCLGFMRKCIPDNDKCCRPNLVCSRTEKWCKYVF-{Amide} | 29 |
| [Glu29]GpTx-1(1-34) | {H}-DCLGFMRKCIPDNDKCCRPNLVCSRTHKECKYVF-{Amide} | 30 |
| [Glu31]GpTx-1(1-34) | {H}-DCLGFMRKCIPDNDKCCRPNLVCSRTHKWCEYVF-{Amide} | 31 |
| [Glu32]GpTx-1(1-34) | {H}-DCLGFMRKCIPDNDKCCRPNLVCSRTHKWCKEVF-{Amide} | 32 |
| [Glu33]GpTx-1(1-34) | {H}-DCLGFMRKCIPDNDKCCRPNLVCSRTHKWCKYEF-{Amide} | 33 |
| [Glu34]GpTx-1(1-34) | {H}-DCLGFMRKCIPDNDKCCRPNLVCSRTHKWCKYVE-{Amide} | 34 |
| GpTx-1(1-34)-Glu | {H}-DCLGFMRKCIPDNDKCCRPNLVCSRTHKWCKYVFE-{Amide} | 35 |
| Lys-GpTx-1(1-34) | {H}-KDCLGFMRKCIPDNDKCCRPNLVCSRTHKWCKYVF-{Amide} | 36 |
| [Lys1]GpTx-1(1-34) | {H}-KCLGFMRKCIPDNDKCCRPNLVCSRTHKWCKYVF-{Amide} | 37 |
| [Lys3]GpTx-1(1-34) | {H}-DCKGFMRKCIPDNDKCCRPNLVCSRTHKWCKYVF-{Amide} | 38 |
| [Lys4]GpTx-1(1-34) | {H}-DCLKFMRKCIPDNDKCCRPNLVCSRTHKWCKYVF-{Amide} | 39 |
| [Lys7]GpTx-1(1-34) | {H}-DCLGFMKKCIPDNDKCCRPNLVCSRTHKWCKYVF-{Amide} | 40 |
| [Lys10]GpTx-1(1-34) | {H}-DCLGFMRKCKPDNDKCCRPNLVCSRTHKWCKYVF-{Amide} | 41 |
| [Lys12]GpTx-1(1-34) | {H}-DCLGFMRKCIPKNDKCCRPNLVCSRTHKWCKYVF-{Amide} | 42 |
| [Ala7]GpTx-1(1-34) | {H}-DCLGFMAKCIPDNDKCCRPNLVCSRTHKWCKYVF-{Amide} | 43 |
| [Ala8]GpTx-1(1-34) | {H}-DCLGFMRACIPDNDKCCRPNLVCSRTHKWCKYVF-{Amide} | 44 |
| [Ala10]GpTx-1(1-34) | {H}-DCLGFMRKCAPDNDKCCRPNLVCSRTHKWCKYVF-{Amide} | 45 |
| [Ala11]GpTx-1(1-34) | {H}-DCLGFMRKCIADNDKCCRPNLVCSRTHKWCKYVF-{Amide} | 46 |
| [Ala29]GpTx-1(1-34) | {H}-DCLGFMRKCIPDNDKCCRPNLVCSRTHKACKYVF-{Amide} | 47 |
| [Lys13]GpTx-1(1-34) | {H}-DCLGFMRKCIPDKDKCCRPNLVCSRTHKWCKYVF-{Amide} | 48 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Lys18]GpTx-1(1-34) | {H}-DCLGFMRKCIPDNDKCCKPNLVCSRTHKWCKYVF-{Amide} | 49 |
| [Lys19]GpTx-1(1-34) | {H}-DCLGFMRKCIPDNDKCCRKNLVCSRTHKWCKYVF-{Amide} | 50 |
| [Lys20]GpTx-1(1-34) | {H}-DCLGFMRKCIPDNDKCCRPKLVCSRTHKWCKYVF-{Amide} | 51 |
| [Lys22]GpTx-1(1-34) | {H}-DCLGFMRKCIPDNDKCCRPNLKCSRTHKWCKYVF-{Amide} | 52 |
| [Lys25]GpTx-1(1-34) | {H}-DCLGFMRKCIPDNDKCCRPNLVCSKTHKWCKYVF-{Amide} | 53 |
| [Lys26]GpTx-1(1-34) | {H}-DCLGFMRKCIPDNDKCCRPNLVCSRKHKWCKYVF-{Amide} | 54 |
| [Lys27]GpTx-1(1-34) | {H}-DCLGFMRKCIPDNDKCCRPNLVCSRTKKWCKYVF-{Amide} | 55 |
| [Lys29]GpTx-1(1-34) | {H}-DCLGFMRKCIPDNDKCCRPNLVCSRTHKKCKYVF-{Amide} | 56 |
| [Lys32]GpTx-1(1-34) | {H}-DCLGFMRKCIPDNDKCCRPNLVCSRTHKWCKKVF-{Amide} | 57 |
| [Lys33]GpTx-1(1-34) | {H}-DCLGFMRKCIPDNDKCCRPNLVCSRTHKWCKYKF-{Amide} | 58 |
| [Lys34]GpTx-1(1-34) | {H}-DCLGFMRKCIPDNDKCCRPNLVCSRTHKWCKYVK-{Amide} | 59 |
| GpTx-1(1-34)-Lys | {H}-DCLGFMRKCIPDNDKCCRPNLVCSRTHKWCKYVFK-{Amide} | 60 |
| Arg-GpTx-1(1-34) | {H}-RDCLGFMRKCIPDNDKCCRPNLVCSRTHKWCKYVF-{Amide} | 61 |
| [Arg1]GpTx-1(1-34) | {H}-RCLGFMRKCIPDNDKCCRPNLVCSRTHKWCKYVF-{Amide} | 62 |
| [Arg4]GpTx-1(1-34) | {H}-DCLRFMRKCIPDNDKCCRPNLVCSRTHKWCKYVF-{Amide} | 63 |
| [Arg6]GpTx-1(1-34) | {H}-DCLGFRRKCIPDNDKCCRPNLVCSRTHKWCKYVF-{Amide} | 64 |
| [Arg8]GpTx-1(1-34) | {H}-DCLGFMRRCIPDNDKCCRPNLVCSRTHKWCKYVF-{Amide} | 65 |
| [Arg10]GpTx-1(1-34) | {H}-DCLGFMRKCRPDNDKCCRPNLVCSRTHKWCKYVF-{Amide} | 66 |
| [Arg12]GpTx-1(1-34) | {H}-DCLGFMRKCIPRNDKCCRPNLVCSRTHKWCKYVF-{Amide} | 67 |
| [Arg15]GpTx-1(1-34) | {H}-DCLGFMRKCIPDNDRCCRPNLVCSRTHKWCKYVF-{Amide} | 68 |
| [Arg20]GpTx-1(1-34) | {H}-DCLGFMRKCIPDNDKCCRPRLVCSRTHKWCKYVF-{Amide} | 69 |
| [Arg26]GpTx-1(1-34) | {H}-DCLGFMRKCIPDNDKCCRPNLVCSRRHKWCKYVF-{Amide} | 70 |
| [Arg27]GpTx-1(1-34) | {H}-DCLGFMRKCIPDNDKCCRPNLVCSRTRKWCKYVF-{Amide} | 71 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Arg28]GpTx-1(1-34) | {H}-DCLGFMRKCIPDNDKCCRPNLVCSRTHRWCKYVF-{Amide} | 72 |
| [Arg31]GpTx-1(1-34) | {H}-DCLGFMRKCIPDNDKCCRPNLVCSRTHKWCRYVF-{Amide} | 73 |
| [Arg33]GpTx-1(1-34) | {H}-DCLGFMRKCIPDNDKCCRPNLVCSRTHKWCKYRF-{Amide} | 74 |
| [Arg34]GpTx-1(1-34) | {H}-DCLGFMRKCIPDNDKCCRPNLVCSRTHKWCKYVR-{Amide} | 75 |
| GpTx-1(1-34)-Arg | {H}-DCLGFMRKCIPDNDKCCRPNLVCSRTHKWCKYVFR-{Amide} | 76 |
| [1-Nal1]GpTx-1(1-34) | {H}-[1-Nal]CLGFMRKCIPDNDKCCRPNLVCSRTHKWCKYVF-{Amide} | 77 |
| [1-Nal10]GpTx-1(1-34) | {H}-DCLGFMRKC[1-Nal]PDNDKCCRPNLVCSRTHKWCKYVF-{Amide} | 78 |
| [1-Nal29]GpTx-1(1-34) | {H}-DCLGFMRKCIPDNDKCCRPNLVCSRTHK[1-Nal]CKYVF-{Amide} | 79 |
| [1-Nal34]GpTx-1(1-34) | {H}-DCLGFMRKCIPDNDKCCRPNLVCSRTHKWCKYV[1-Nal]-{Amide} | 80 |
| [Trp1]GpTx-1(1-34) | {H}-WCLGFMRKCIPDNDKCCRPNLVCSRTHKWCKYVF-{Amide} | 81 |
| [Trp5]GpTx-1(1-34) | {H}-DCLGWMRKCIPDNDKCCRPNLVCSRTHKWCKYVF-{Amide} | 82 |
| [Trp10]GpTx-1(1-34) | {H}-DCLGFMRKCWPDNDKCCRPNLVCSRTHKWCKYVF-{Amide} | 83 |
| [Trp27]GpTx-1(1-34) | {H}-DCLGFMRKCIPDNDKCCRPNLVCSRTWKWCKYVF-{Amide} | 84 |
| [Trp32]GpTx-1(1-34) | {H}-DCLGFMRKCIPDNDKCCRPNLVCSRTHKWCKWVF-{Amide} | 85 |
| [Trp34]GpTx-1(1-34) | {H}-DCLGFMRKCIPDNDKCCRPNLVCSRTHKWCKYVW-{Amide} | 86 |
| GpTx-1(1-34)-Trp | {H}-DCLGFMRKCIPDNDKCCRPNLVCSRTHKWCKYVFW-{Amide} | 87 |
| [Ile5]GpTx-1(1-34) | {H}-DCLGIMRKCIPDNDKCCRPNLVCSRTHKWCKYVF-{Amide} | 88 |
| [Phe6]GpTx-1(1-34) | {H}-DCLGFFRKCIPDNDKCCRPNLVCSRTHKWCKYVF-{Amide} | 89 |
| [Asn10]GpTx-1(1-34) | {H}-DCLGFMRKCNPDNDKCCRPNLVCSRTHKWCKYVF-{Amide} | 90 |
| [Ser12]GpTx-1(1-34) | {H}-DCLGFMRKCIPSNDKCCRPNLVCSRTHKWCKYVF-{Amide} | 91 |
| [Gln15]GpTx-1(1-34) | {H}-DCLGFMRKCIPDNDQCCRPNLVCSRTHKWCKYVF-{Amide} | 92 |
| [Ser-Ser19]GpTx-1(1-34) | {H}-DCLGFMRKCIPDNDKCCRSSNLVCSRTHKWCKYVF-{Amide} | 93 |
| [Lys26;Thr27]GpTx-1(1-34) | {H}-DCLGFMRKCIPDNDKCCRPNLVCSRKTKWCKYVF-{Amide} | 94 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Gln33]GpTx-1(1-34) | {H}-DCLGFMRKCIPDNDKCCRPNLVCSRTHKWCKYQF-{Amide} | 95 |
| [Ile34]GpTx-1(1-34) | {H}-DCLGFMRKCIPDNDKCCRPNLVCSRTHKWCKYVI-{Amide} | 96 |
| [Tyr1]GpTx-1(1-34) | {H}-YCLGFMRKCIPDNDKCCRPNLVCSRTHKWCKYVF-{Amide} | 97 |
| [Gln3]GpTx-1(1-34) | {H}-DCQGFMRKCIPDNDKCCRPNLVCSRTHKWCKYVF-{Amide} | 98 |
| [Lys32; 1-Nal34]GpTx-1(1-34)-Trp | {H}-DCLGFMRKCIPDNDKCCRPNLVCSRTHKWCKKV[1-Nal]W-{Amide} | 99 |
| Ala-GpTx-1(1-34) | {H}-ADCLGFMRKCIPDNDKCCRPNLVCSRTHKWCKYVF-{Amide} | 100 |
| [Ala34]GpTx-1(1-34) | {H}-DCLGFMRKCIPDNDKCCRPNLVCSRTHKWCKYVA-{Amide} | 101 |
| [Glu22]GpTx-1(1-34) | {H}-DCLGFMRKCIPDNDKCCRPNLECSRTHKWCKYVF-{Amide} | 102 |
| [Arg13]GpTx-1(1-34) | {H}-DCLGFMRKCIPDRDKCCRPNLVCSRTHKWCKYVF-{Amide} | 103 |
| [Arg29]GpTx-1(1-34) | {H}-DCLGFMRKCIPDNDKCCRPNLVCSRTHKRCKYVF-{Amide} | 104 |
| [1-Nal5]GpTx-1(1-34) | {H}-DCLG[1-Nal]MRKCIPDNDKCCRPNLVCSRTHKWCKYVF-{Amide} | 105 |
| Trp-GpTx-1(1-34) | {H}-WDCLGFMRKCIPDNDKCCRPNLVCSRTHKWCKYVF-{Amide} | 106 |
| GpTx-1(1-34)-FreeAcid | {H}-DCLGFMRKCIPDNDKCCRPNLVCSRTHKWCKYVF-{FreeAcid} | 107 |
| GpTx-1(2-34) | {H}-CLGFMRKCIPDNDKCCRPNLVCSRTHKWCKYVF-{Amide} | 108 |
| [Phe27]GpTx-1(1-34) | {H}-DCLGFMRKCIPDNDKCCRPNLVCSRTFKWCKYVF-{Amide} | 109 |
| [Tyr27]GpTx-1(1-34) | {H}-DCLGFMRKCIPDNDKCCRPNLVCSRTYKWCKYVF-{Amide} | 110 |
| [Leu27]GpTx-1(1-34) | {H}-DCLGFMRKCIPDNDKCCRPNLVCSRTLKWCKYVF-{Amide} | 111 |
| [Phe29]GpTx-1(1-34) | {H}-DCLGFMRKCIPDNDKCCRPNLVCSRTHKFCKYVF-{Amide} | 112 |
| [Tyr29]GpTx-1(1-34) | {H}-DCLGFMRKCIPDNDKCCRPNLVCSRTHKYCKYVF-{Amide} | 113 |
| [Leu29]GpTx-1(1-34) | {H}-DCLGFMRKCIPDNDKCCRPNLVCSRTHKLCKYVF-{Amide} | 114 |
| [Cit7]GpTx-1(1-34) | {H}-DCLGFM[Cit]KCIPDNDKCCRPNLVCSRTHKWCKYVF-{Amide} | 115 |
| [Cit18]GpTx-1(1-34) | {H}-DCLGFMRKCIPDNDKCC[Cit]PNLVCSRTHKWCKYVF-{Amide} | 116 |
| [Cit25]GpTx-1(1-34) | {H}-DCLGFMRKCIPDNDKCCRPNLVCS[Cit]THKWCKYVF-{Amide} | 117 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Thr8]GpTx-1(1-34) | {H}-DCLGFMRTCIPDNDKCCRPNLVCSRTHKWCKYVF-{Amide} | 118 |
| [Asp10]GpTx-1(1-34) | {H}-DCLGFMRKCDPDNDKCCRPNLVCSRTHKWCKYVF-{Amide} | 119 |
| [Met21]GpTx-1(1-34) | {H}-DCLGFMRKCIPDNDKCCRPNMVCSRTHKWCKYVF-{Amide} | 120 |
| [Leu26]GpTx-1(1-34) | {H}-DCLGFMRKCIPDNDKCCRPNLVCSRLHKWCKYVF-{Amide} | 121 |
| [Leu34]GpTx-1(1-34) | {H}-DCLGFMRKCIPDNDKCCRPNLVCSRTHKWCKYVL-{Amide} | 122 |
| [Nle6]GpTx-1(1-34) | {H}-DCLGF[Nle]RKCIPDNDKCCRPNLVCSRTHKWCKYVF-{Amide} | 123 |
| [2-Abu6]GpTx-1(1-34) | {H}-DCLGF[2-Abu]RKCIPDNDKCCRPNLVCSRTHKWCKYVF-{Amide} | 124 |
| [2-Abu2,17]GpTx-1(1-34) | {H}-D[2-Abu]LGFMRKCIPDNDKC[2-Abu]RPNLVCSRTHKWCKYVF-{Amide} | 125 |
| [Gly19]GpTx-1(1-34) | {H}-DCLGFMRKCIPDNDKCCRGNLVCSRTHKWCKYVF-{Amide} | 126 |
| [Lys32]GpTx-1(1-34)-Trp | {H}-DCLGFMRKCIPDNDKCCRPNLVCSRTHKWCKKVFW-{Amide} | 127 |
| [2-Nal5]GpTx-1(1-34) | {H}-DCLG[2-Nal]MRKCIPDNDKCCRPNLVCSRTHKWCKYVF-{Amide} | 128 |
| [2-Nal29]GpTx-1(1-34) | {H}-DCLGFMRKCIPDNDKCCRPNLVCSRTHK[2-Nal]CKYVF-{Amide} | 129 |
| [2-Nal34]GpTx-1(1-34) | {H}-DCLGFMRKCIPDNDKCCRPNLVCSRTHKWCKYV[2-Nal]-{Amide} | 130 |
| GpTx-1(1-34)-2-Nal | {H}-DCLGFMRKCIPDNDKCCRPNLVCSRTHKWCKYVF[2-Nal]-{Amide} | 131 |
| Ac-GpTx-1(1-34) | {Acetyl}DCLGFMRKCIPDNDKCCRPNLVCSRTHKWCKYVF-{Amide} | 132 |
| GpTx-1(1-34)-Trp-FreeAcid | {H}-DCLGFMRKCIPDNDKCCRPNLVCSRTHKWCKYVFW{Free Acid} | 133 |
| [Glu18;desAsn20]GpTx-1(1-34) | {H}-DCLGFMRKCIPDNDKCCEGLVCSRTHKWCKYVF-{Amide} | 134 |
| [2-Abu9,23]GpTx-1(1-34) | {H}-DCLGFMRK[2-Abu]IPDNDKCCRPNLV[2-Abu]SRTHKWCKYVF-{Amide} | 135 |
| [2-Nal5,34]GpTx-1(1-34) | {H}-DCLG[2-Nal]MRKCIPDNDKCCRPNLVCSRTHKWCKYV[2-Nal]-{Amide} | 136 |
| [2-Nal5;1-Nal34]GpTx-1(1-34) | {H}-DCLG[2-Nal]MRKCIPDNDKCCRPNLVCSRTHKWCKYV[1-Nal]-{Amide} | 137 |
| [1-Nal34]GpTx-1(1-34)-Trp | {H}-DCLGFMRKCIPDNDKCCRPNLVCSRTHKWCKYV[1-Nal]W-{Amide} | 138 |
| [2-Nal34]GpTx-1(1-34)-Trp | {H}-DCLGFMRKCIPDNDKCCRPNLVCSRTHKWCKYV[2-Nal]W-{Amide} | 139 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala2,17]GpTx-1(1-34) | {H}-DALGFMRKCIPDNDKCARPNLVCSRTHKWCKYVF-{Amide} | 140 |
| [Ala4]GpTx-1(1-34) | {H}-DCLAFMRKCIPDNDKCCRPNLVCSRTHKWCKYVF-{Amide} | 141 |
| [Ala24]GpTx-1(1-34) | {H}-DCLGFMRKCIPDNDKCCRPNLVCARTHKWCKYVF-{Amide} | 142 |
| [Glu5]GpTx-1(1-34) | {H}-DCLGEMRKCIPDNDKCCRPNLVCSRTHKWCKYVF-{Amide} | 143 |
| [Glu6]GpTx-1(1-34) | {H}-DCLGFERKCIPDNDKCCRPNLVCSRTHKWCKYVF-{Amide} | 144 |
| [Glu7]GpTx-1(1-34) | {H}-DCLGFMEKCIPDNDKCCRPNLVCSRTHKWCKYVF-{Amide} | 145 |
| [Glu10]GpTx-1(1-34) | {H}-DCLGFMRKCEPDNDKCCRPNLVCSRTHKWCKYVF-{Amide} | 146 |
| [Glu11]GpTx-1(1-34) | {H}-DCLGFMRKCIEDNDKCCRPNLVCSRTHKWCKYVF-{Amide} | 147 |
| [Glu18]GpTx-1(1-34) | {H}-DCLGFMRKCIPDNDKCCEPNLVCSRTHKWCKYVF-{Amide} | 148 |
| [Glu20]GpTx-1(1-34) | {H}-DCLGFMRKCIPDNDKCCRPELVCSRTHKWCKYVF-{Amide} | 149 |
| [Glu24]GpTx-1(1-34) | {H}-DCLGFMRKCIPDNDKCCRPNLVCERTHKWCKYVF-{Amide} | 150 |
| [Glu25]GpTx-1(1-34) | {H}-DCLGFMRKCIPDNDKCCRPNLVCSETHKWCKYVF-{Amide} | 151 |
| [Glu26]GpTx-1(1-34) | {H}-DCLGFMRKCIPDNDKCCRPNLVCSREHKWCKYVF-{Amide} | 152 |
| [Glu28]GpTx-1(1-34) | {H}-DCLGFMRKCIPDNDKCCRPNLVCSRTHEWCKYVF-{Amide} | 153 |
| [Lys6]GpTx-1(1-34) | {H}-DCLGFKRKCIPDNDKCCRPNLVCSRTHKWCKYVF-{Amide} | 154 |
| [Arg3]GpTx-1(1-34) | {H}-DCRGFMRKCIPDNDKCCRPNLVCSRTHKWCKYVF-{Amide} | 155 |
| [Arg5]GpTx-1(1-34) | {H}-DCLGRMRKCIPDNDKCCRPNLVCSRTHKWCKYVF-{Amide} | 156 |
| [Arg19]GpTx-1(1-34) | {H}-DCLGFMRKCIPDNDKCCRRNLVCSRTHKWCKYVF-{Amide} | 157 |
| [Arg22]GpTx-1(1-34) | {H}-DCLGFMRKCIPDNDKCCRPNLRCSRTHKWCKYVF-{Amide} | 158 |
| [Arg32]GpTx-1(1-34) | {H}-DCLGFMRKCIPDNDKCCRPNLVCSRTHKWCKRVF-{Amide} | 159 |
| [1-Nal4]GpTx-1(1-34) | {H}-DCL[1-Nal]FMRKCIPDNDKCCRPNLVCSRTHKWCKYVF-{Amide} | 160 |
| [1-Nal6]GpTx-1(1-34) | {H}-DCLGF[1-Nal]RKCIPDNDKCCRPNLVCSRTHKWCKYVF-{Amide} | 161 |
| [1-Nal12]GpTx-1(1-34) | {H}-DCLGFMRKCIP[1-Nal]NDKCCRPNLVCSRTHKWCKYVF-{Amide} | 162 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [1-Nal13]GpTx-1(1-34) | {H}-DCLGFMRKCIPD[1-Nal]DKCCRPNLVCSRTHKWCKYVF-{Amide} | 163 |
| [1-Nal20]GpTx-1(1-34) | {H}-DCLGFMRKCIPDNDKCCRP[1-Nal]LVCSRTHKWCKYVF-{Amide} | 164 |
| [1-Nal21]GpTx-1(1-34) | {H}-DCLGFMRKCIPDNDKCCRPN[1-Nal]VCSRTHKWCKYVF-{Amide} | 165 |
| [1-Nal27]GpTx-1(1-34) | {H}-DCLGFMRKCIPDNDKCCRPNLVCSRT[1-Nal]KWCKYVF-{Amide} | 166 |
| [1-Nal32]GpTx-1(1-34) | {H}-DCLGFMRKCIPDNDKCCRPNLVCSRTHKWCK[1-Nal]VF-{Amide} | 167 |
| [1-Nal33]GpTx-1(1-34) | {H}-DCLGFMRKCIPDNDKCCRPNLVCSRTHKWCKY[1-Nal]F-{Amide} | 168 |
| [Trp4]GpTx-1(1-34) | {H}-DCLWFMRKCIPDNDKCCRPNLVCSRTHKWCKYVF-{Amide} | 169 |
| [Trp6]GpTx-1(1-34) | {H}-DCLGFWRKCIPDNDKCCRPNLVCSRTHKWCKYVF-{Amide} | 170 |
| [Trp11]GpTx-1(1-34) | {H}-DCLGFMRKCIWDNDKCCRPNLVCSRTHKWCKYVF-{Amide} | 171 |
| [Trp12]GpTx-1(1-34) | {H}-DCLGFMRKCIPWNDKCCRPNLVCSRTHKWCKYVF-{Amide} | 172 |
| [Trp13]GpTx-1(1-34) | {H}-DCLGFMRKCIPDWDKCCRPNLVCSRTHKWCKYVF-{Amide} | 173 |
| [Trp18]GpTx-1(1-34) | {H}-DCLGFMRKCIPDNDKCCWPNLVCSRTHKWCKYVF-{Amide} | 174 |
| [Trp20]GpTx-1(1-34) | {H}-DCLGFMRKCIPDNDKCCRPWLVCSRTHKWCKYVF-{Amide} | 175 |
| [Trp21]GpTx-1(1-34) | {H}-DCLGFMRKCIPDNDKCCRPNWVCSRTHKWCKYVF-{Amide} | 176 |
| [Trp22]GpTx-1(1-34) | {H}-DCLGFMRKCIPDNDKCCRPNLWCSRTHKWCKYVF-{Amide} | 177 |
| [Trp26]GpTx-1(1-34) | {H}-DCLGFMRKCIPDNDKCCRPNLVCSRWHKWCKYVF-{Amide} | 178 |
| [Trp31]GpTx-1(1-34) | {H}-DCLGFMRKCIPDNDKCCRPNLVCSRTHKWCWYVF-{Amide} | 179 |
| [Trp33]GpTx-1(1-34) | {H}-DCLGFMRKCIPDNDKCCRPNLVCSRTHKWCKYWF-{Amide} | 180 |
| [Ser19]GpTx-1(1-34) | {H}-DCLGFMRKCIPDNDKCCRSNLVCSRTHKWCKYVF-{Amide} | 181 |
| [Gln33;1-Nal34]GpTx-1(1-34) | {H}-DCLGFMRKCIPDNDKCCRPNLVCSRTHKWCKYQ[1-Nal]-{Amide} | 182 |
| [Arg28;Gln33;1-Nal34]GpTx-1(1-34) | {H}-DCLGFMRKCIPDNDKCCRPNLVCSRTHRWCKYQ[1-Nal]-{Amide} | 183 |
| [Arg20;Gln33;1-Nal34]GpTx-1(1-34) | {H}-DCLGFMRKCIPDNDKCCRPRLVCSRTHKWCKYQ[1-Nal]-{Amide} | 184 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Arg20,28;Gln33;1-Nal34]GpTx-1(1-34) | {H}-DCLGFMRKCIPDNDKCCRPRLVCSRTHRWCKYQ[1-Nal]-{Amide} | 185 |
| [Arg15;Gln33;1-Nal34]GpTx-1(1-34) | {H}-DCLGFMRKCIPDNDRCCRPNLVCSRTHKWCKYQ[1-Nal]-{Amide} | 186 |
| Arg-GpTx-1(1-34)-Trp | {H}-RDCLGFMRKCIPDNDKCCRPNLVCSRTHKWCKYVFW-{Amide} | 187 |
| [PE1]GpTx-1(1-34) | {H}-[PE]CLGFMRKCIPDNDKCCRPNLVCSRTHKWCKYVF-{Amide} | 188 |
| [Ile1]GpTx-1(1-34) | {H}-ICLGFMRKCIPDNDKCCRPNLVCSRTHKWCKYVF-{Amide} | 189 |
| [Pro1]GpTx-1(1-34) | {H}-PCLGFMRKCIPDNDKCCRPNLVCSRTHKWCKYVF-{Amide} | 190 |
| [Ser1]GpTx-1(1-34) | {H}-SCLGFMRKCIPDNDKCCRPNLVCSRTHKWCKYVF-{Amide} | 191 |
| [Thr1]GpTx-1(1-34) | {H}-TCLGFMRKCIPDNDKCCRPNLVCSRTHKWCKYVF-{Amide} | 192 |
| [Leu12]GpTx-1(1-34) | {H}-DCLGFMRKCIPLNDKCCRPNLVCSRTHKWCKYVF-{Amide} | 193 |
| [Gly12]GpTx-1(1-34) | {H}-DCLGFMRKCIPGNDKCCRPNLVCSRTHKWCKYVF-{Amide} | 194 |
| [Ile12]GpTx-1(1-34) | {H}-DCLGFMRKCIPINDKCCRPNLVCSRTHKWCKYVF-{Amide} | 195 |
| [Thr12]GpTx-1(1-34) | {H}-DCLGFMRKCIPTNDKCCRPNLVCSRTHKWCKYVF-{Amide} | 196 |
| [Tyr12]GpTx-1(1-34) | {H}-DCLGFMRKCIPYNDKCCRPNLVCSRTHKWCKYVF-{Amide} | 197 |
| [Gly20]GpTx-1(1-34) | {H}-DCLGFMRKCIPDNDKCCRPGLVCSRTHKWCKYVF-{Amide} | 198 |
| [Phe20]GpTx-1(1-34) | {H}-DCLGFMRKCIPDNDKCCRPFLVCSRTHKWCKYVF-{Amide} | 199 |
| [Tyr20]GpTx-1(1-34) | {H}-DCLGFMRKCIPDNDKCCRPYLVCSRTHKWCKYVF-{Amide} | 200 |
| 1-Nal-GpTx-1(1-34) | {H}-[1-Nal]DCLGFMRKCIPDNDKCCRPNLVCSRTHKWCKYVF-{Amide} | 201 |
| [Trp3]GpTx-1(1-34) | {H}-DCWGFMRKCIPDNDKCCRPNLVCSRTHKWCKYVF-{Amide} | 202 |
| [1-Nal3]GpTx-1(1-34) | {H}-DC[1-Nal]GFMRKCIPDNDKCCRPNLVCSRTHKWCKYVF-{Amide} | 203 |
| [Lys5]GpTx-1(1-34) | {H}-DCLGKMRKCIPDNDKCCRPNLVCSRTHKWCKYVF-{Amide} | 204 |
| [Trp7]GpTx-1(1-34) | {H}-DCLGFMWKCIPDNDKCCRPNLVCSRTHKWCKYVF-{Amide} | 205 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [1-Nal7]GpTx-1(1-34) | {H}-DCLGFM[1-Nal]KCIPDNDKCCRPNLVCSRTHKWCKYVF-{Amide} | 206 |
| [Trp8]GpTx-1(1-34) | {H}-DCLGFMRWCIPDNDKCCRPNLVCSRTHKWCKYVF-{Amide} | 207 |
| [1-Nal8]GpTx-1(1-34) | {H}-DCLGFMR[1-Nal]CIPDNDKCCRPNLVCSRTHKWCKYVF-{Amide} | 208 |
| [Lys11]GpTx-1(1-34) | {H}-DCLGFMRKCIKDNDKCCRPNLVCSRTHKWCKYVF-{Amide} | 209 |
| [Arg11]GpTx-1(1-34) | {H}-DCLGFMRKCIRDNDKCCRPNLVCSRTHKWCKYVF-{Amide} | 210 |
| [1-Nal11]GpTx-1(1-34) | {H}-DCLGFMRKCI[1-Nal]DNDKCCRPNLVCSRTHKWCKYVF-{Amide} | 211 |
| [Ala14]GpTx-1(1-34) | {H}-DCLGFMRKCIPDNAKCCRPNLVCSRTHKWCKYVF-{Amide} | 212 |
| [Glu14]GpTx-1(1-34) | {H}-DCLGFMRKCIPDNEKCCRPNLVCSRTHKWCKYVF-{Amide} | 213 |
| [Lys14]GpTx-1(1-34) | {H}-DCLGFMRKCIPDNKKCCRPNLVCSRTHKWCKYVF-{Amide} | 214 |
| [Arg14]GpTx-1(1-34) | {H}-DCLGFMRKCIPDNRKCCRPNLVCSRTHKWCKYVF-{Amide} | 215 |
| [Trp14]GpTx-1(1-34) | {H}-DCLGFMRKCIPDNWKCCRPNLVCSRTHKWCKYVF-{Amide} | 216 |
| [1-Nal14]GpTx-1(1-34) | {H}-DCLGFMRKCIPDN[1-Nal]KCCRPNLVCSRTHKWCKYVF-{Amide} | 217 |
| [Trp15]GpTx-1(1-34) | {H}-DCLGFMRKCIPDNDWCCRPNLVCSRTHKWCKYVF-{Amide} | 218 |
| [1-Nal15]GpTx-1(1-34) | {H}-DCLGFMRKCIPDND[1-Nal]CCRPNLVCSRTHKWCKYVF-{Amide} | 219 |
| [Ala18]GpTx-1(1-34) | {H}-DCLGFMRKCIPDNDKCCAPNLVCSRTHKWCKYVF-{Amide} | 220 |
| [1-Nal18]GpTx-1(1-34) | {H}-DCLGFMRKCIPDNDKCC[1-Nal]PNLVCSRTHKWCKYVF-{Amide} | 221 |
| [Ala19]GpTx-1(1-34) | {H}-DCLGFMRKCIPDNDKCCRANLVCSRTHKWCKYVF-{Amide} | 222 |
| [Glu19]GpTx-1(1-34) | {H}-DCLGFMRKCIPDNDKCCRENLVCSRTHKWCKYVF-{Amide} | 223 |
| [Trp19]GpTx-1(1-34) | {H}-DCLGFMRKCIPDNDKCCRWNLVCSRTHKWCKYVF-{Amide} | 224 |
| [1-Nal19]GpTx-1(1-34) | {H}-DCLGFMRKCIPDNDKCCR[1-Nal]NLVCSRTHKWCKYVF-{Amide} | 225 |
| [Ala21]GpTx-1(1-34) | {H}-DCLGFMRKCIPDNDKCCRPNAVCSRTHKWCKYVF-{Amide} | 226 |
| [Glu21]GpTx-1(1-34) | {H}-DCLGFMRKCIPDNDKCCRPNEVCSRTHKWCKYVF-{Amide} | 227 |
| [Lys21]GpTx-1(1-34) | {H}-DCLGFMRKCIPDNDKCCRPNKVCSRTHKWCKYVF-{Amide} | 228 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Arg21]GpTx-1(1-34) | {H}-DCLGFMRKCIPDNDKCCRPNRVCSRTHKWCKYVF-{Amide} | 229 |
| [1-Nal22]GpTx-1(1-34) | {H}-DCLGFMRKCIPDNDKCCRPNL[1-Nal]CSRTHKWCKYVF-{Amide} | 230 |
| [Lys24]GpTx-1(1-34) | {H}-DCLGFMRKCIPDNDKCCRPNLVCKRTHKWCKYVF-{Amide} | 231 |
| [Arg24]GpTx-1(1-34) | {H}-DCLGFMRKCIPDNDKCCRPNLVCRRTHKWCKYVF-{Amide} | 232 |
| [Trp24]GpTx-1(1-34) | {H}-DCLGFMRKCIPDNDKCCRPNLVCWRTHKWCKYVF-{Amide} | 233 |
| [1-Nal24]GpTx-1(1-34) | {H}-DCLGFMRKCIPDNDKCCRPNLVC[1-Nal]RTHKWCKYVF-{Amide} | 234 |
| [Trp25]GpTx-1(1-34) | {H}-DCLGFMRKCIPDNDKCCRPNLVCSWTHKWCKYVF-{Amide} | 235 |
| [1-Nal25]GpTx-1(1-34) | {H}-DCLGFMRKCIPDNDKCCRPNLVCS[1-Nal]THKWCKYVF-{Amide} | 236 |
| [1-Nal26]GpTx-1(1-34) | {H}-DCLGFMRKCIPDNDKCCRPNLVCSR[1-Nal]HKWCKYVF-{Amide} | 237 |
| [Trp28]GpTx-1(1-34) | {H}-DCLGFMRKCIPDNDKCCRPNLVCSRTHWWCKYVF-{Amide} | 238 |
| [1-Nal28]GpTx-1(1-34) | {H}-DCLGFMRKCIPDNDKCCRPNLVCSRTH[1-Nal]WCKYVF-{Amide} | 239 |
| [1-Nal31]GpTx-1(1-34) | {H}-DCLGFMRKCIPDNDKCCRPNLVCSRTHKWC[1-Nal]YVF-{Amide} | 240 |
| GpTx-1(1-34)-1-Nal | {H}-DCLGFMRKCIPDNDKCCRPNLVCSRTHKWCKYVF[1Nal]-{Amide} | 241 |
| [Bip5]GpTx-1(1-34) | {H}-DCLG[Bip]MRKCIPDNDKCCRPNLVCSRTHKWCKYVF-{Amide} | 242 |
| [Cha5]GpTx-1(1-34) | {H}-DCLG[Cha]MRKCIPDNDKCCRPNLVCSRTHKWCKYVF-{Amide} | 243 |
| [Leu6]GpTx-1(1-34) | {H}-DCLGFLRKCIPDNDKCCRPNLVCSRTHKWCKYVF-{Amide} | 244 |
| [Cha6]GpTx-1(1-34) | {H}-DCLGF[Cha]RKCIPDNDKCCRPNLVCSRTHKWCKYVF-{Amide} | 245 |
| [1'NMeW32]GpTx-1(1-34) | {H}-DCLGFMRKCIPDNDKCCRPNLVCSRTHKWCK[1'NMeW]VF-{Amide} | 246 |
| [pI-Phe5]GpTx-1(1-34) | {H}-DCLG[pI-Phe]MRKCIPDNDKCCRPNLVCSRTHKWCKYVF-{Amide} | 247 |
| [Ile33]GpTx-1(1-34) | {H}-DCLGFMRKCIPDNDKCCRPNLVCSRTHKWCKYIF-{Amide} | 248 |
| [pI-Phe33]GpTx-1(1-34) | {H}-DCLGFMRKCIPDNDKCCRPNLVCSRTHKWCKY[pI-Phe]F-{Amide} | 249 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [1'NMeW33]GpTx-1(1-34) | {H}-DCLGFMRKCIPDNDKCCRPNLVCSRTHKWCKY[1'NMeW]F-{Amide} | 250 |
| [Arg28;1-Nal32]GpTx-1(1-34) | {H}-DCLGFMRKCIPDNDKCCRPNLVCSRTHRWCK[1-Nal]VF-{Amide} | 251 |
| [Ala5;Trp33]GpTx-1(1-34) | {H}-DCLGAMRKCIPDNDKCCRPNLVCSRTHKWCKYWF-{Amide} | 252 |
| [Ala5;Trp32]GpTx-1(1-34) | {H}-DCLGAMRKCIPDNDKCCRPNLVCSRTHKWCKWVF-{Amide} | 253 |
| [Ala5;1-Nal32]GpTx-1(1-34) | {H}-DCLGAMRKCIPDNDKCCRPNLVCSRTHKWCK[1-Nal]VF-{Amide} | 254 |
| [Ala5;Leu26]GpTx-1(1-34) | {H}-DCLGAMRKCIPDNDKCCRPNLVCSRLHKWCKYVF-{Amide} | 255 |
| [Ala5;1-Nal6]GpTx-1(1-34) | {H}-DCLGA[1-Nal]RKCIPDNDKCCRPNLVCSRTHKWCKYVF-{Amide} | 256 |
| [Ala5;Phe6]GpTx-1(1-34) | {H}-DCLGAFRKCIPDNDKCCRPNLVCSRTHKWCKYVF-{Amide} | 257 |
| [Ala5;1-Nal33]GpTx-1(1-34) | {H}-DCLGAMRKCIPDNDKCCRPNLVCSRTHKWCKY[1-Nal]F-{Amide} | 258 |
| [Ala5;1-Nal10]GpTx-1(1-34) | {H}-DCLGAMRKC[1-Nal]PDNDKCCRPNLVCSRTHKWCKYVF-{Amide} | 259 |
| [Ala5;Arg28]GpTx-1(1-34) | {H}-DCLGAMRKCIPDNDKCCRPNLVCSRTHRWCKYVF-{Amide} | 260 |
| [Ala5;Trp6]GpTx-1(1-34) | {H}-DCLGAWRKCIPDNDKCCRPNLVCSRTHKWCKYVF-{Amide} | 261 |
| [Ala5;Phe6;Leu26;Arg28]GpTx-1(1-34) | {H}-DCLGAFRKCIPDNDKCCRPNLVCSRLHRWCKYVF-{Amide} | 262 |
| [Ala5;Phe6;Leu26] GpTx-1(1-34) | {H}-DCLGAFRKCIPDNDKCCRPNLVCSRLHKWCKYVF-{Amide} | 263 |
| [1'NMeW5]GpTx-1(1-34) | {H}-DCLG[1'NMeW]MRKCIPDNDKCCRPNLVCSRTHKWCKYVF-{Amide} | 264 |
| [Gly5]GpTx-1(1-34) | {H}-DCLGGMRKCIPDNDKCCRPNLVCSRTHKWCKYVF-{Amide} | 265 |
| [His5]GpTx-1(1-34) | {H}-DCLGHMRKCIPDNDKCCRPNLVCSRTHKWCKYVF-{Amide} | 266 |
| [Leu5]GpTx-1(1-34) | {H}-DCLGLMRKCIPDNDKCCRPNLVCSRTHKWCKYVF-{Amide} | 267 |
| [Met5]GpTx-1(1-34) | {H}-DCLGMMRKCIPDNDKCCRPNLVCSRTHKWCKYVF-{Amide} | 268 |
| [Pro5]GpTx-1(1-34) | {H}-DCLGPMRKCIPDNDKCCRPNLVCSRTHKWCKYVF-{Amide} | 269 |
| [Thr5]GpTx-1(1-34) | {H}-DCLGTMRKCIPDNDKCCRPNLVCSRTHKWCKYVF-{Amide} | 270 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Tyr5]GpTx-1(1-34) | {H}-DCLGYMRKCIPDNDKCCRPNLVCSRTHKWCKYVF-{Amide} | 271 |
| [Val5]GpTx-1(1-34) | {H}-DCLGVMRKCIPDNDKCCRPNLVCSRTHKWCKYVF-{Amide} | 272 |
| [D-Phe5]GpTx-1(1-34) | {H}-DCLGfMRKCIPDNDKCCRPNLVCSRTHKWCKYVF-{Amide} | 273 |
| [NMeTrp5]GpTx-1(1-34) | {H}-DCLG[NMeTrp]MRKCIPDNDKCCRPNLVCSRTHKWCKYVF-{Amide} | 274 |
| [Phg5]GpTx-1(1-34) | {H}-DCLG[Phg]MRKCIPDNDKCCRPNLVCSRTHKWCKYVF-{Amide} | 275 |
| [4CO2-F5]GpTx-1(1-34) | {H}-DCLG[4CO2-F]MRKCIPDNDKCCRPNLVCSRTHKWCKYVF-{Amide} | 276 |
| [2PAL5]GpTx-1(1-34) | {H}-DCLG[2PAL]MRKCIPDNDKCCRPNLVCSRTHKWCKYVF-{Amide} | 277 |
| [Asn6]GpTx-1(1-34) | {H}-DCLGFNRKCIPDNDKCCRPNLVCSRTHKWCKYVF-{Amide} | 278 |
| [Gln6]GpTx-1(1-34) | {H}-DCLGFQRKCIPDNDKCCRPNLVCSRTHKWCKYVF-{Amide} | 279 |
| [Gly6]GpTx-1(1-34) | {H}-DCLGFGRKCIPDNDKCCRPNLVCSRTHKWCKYVF-{Amide} | 280 |
| [His6]GpTx-1(1-34) | {H}-DCLGFHRKCIPDNDKCCRPNLVCSRTHKWCKYVF-{Amide} | 281 |
| [Ile6]GpTx-1(1-34) | {H}-DCLGFIRKCIPDNDKCCRPNLVCSRTHKWCKYVF-{Amide} | 282 |
| [Pro6]GpTx-1(1-34) | {H}-DCLGFPRKCIPDNDKCCRPNLVCSRTHKWCKYVF-{Amide} | 283 |
| [Ser6]GpTx-1(1-34) | {H}-DCLGFSRKCIPDNDKCCRPNLVCSRTHKWCKYVF-{Amide} | 284 |
| [Thr6]GpTx-1(1-34) | {H}-DCLGFTRKCIPDNDKCCRPNLVCSRTHKWCKYVF-{Amide} | 285 |
| [Tyr6]GpTx-1(1-34) | {H}-DCLGFYRKCIPDNDKCCRPNLVCSRTHKWCKYVF-{Amide} | 286 |
| [Val6]GpTx-1(1-34) | {H}-DCLGFVRKCIPDNDKCCRPNLVCSRTHKWCKYVF-{Amide} | 287 |
| [Phg6]GpTx-1(1-34) | {H}-DCLGF[Phg]RKCIPDNDKCCRPNLVCSRTHKWCKYVF-{Amide} | 288 |
| [NMeTrp6]GpTx-1(1-34) | {H}-DCLGF[NMeTrp]RKCIPDNDKCCRPNLVCSRTHKWCKYVF-{Amide} | 289 |
| [NMePhe6]GpTx-1(1-34) | {H}-DCLGF[NMePhe]RKCIPDNDKCCRPNLVCSRTHKWCKYVF-{Amide} | 290 |
| [pI-Phe6]GpTx-1(1-34) | {H}-DCLGF[pI-Phe]RKCIPDNDKCCRPNLVCSRTHKWCKYVF-{Amide} | 291 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [1'NMeW6]GpTx-1(1-34) | {H}-DCLGF[1'NMeW]RKCIPDNDKCCRPNLVCSRTHKWCKYVF-{Amide} | 292 |
| [4CO2-F6]GpTx-1(1-34) | {H}-DCLGF[4CO2-F]RKCIPDNDKCCRPNLVCSRTHKWCKYVF-{Amide} | 293 |
| [2PAL6]GpTx-1(1-34) | {H}-DCLGF[2PAL]RKCIPDNDKCCRPNLVCSRTHKWCKYVF-{Amide} | 294 |
| [K(Me2)7]GpTx-1(1-34) | {H}-DCLGFM[K(Me2)]KCIPDNDKCCRPNLVCSRTHKWCKYVF-{Amide} | 295 |
| [SDMA7]GpTx-1(1-34) | {H}-DCLGFM[SDMA]KCIPDNDKCCRPNLVCSRTHKWCKYVF-{Amide} | 296 |
| [SDMA8]GpTx-1(1-34) | {H}-DCLGFMR[SDMA]CIPDNDKCCRPNLVCSRTHKWCKYVF-{Amide} | 297 |
| [K(Me2)8]GpTx-1(1-34) | {H}-DCLGFMR[K(Me2)]CIPDNDKCCRPNLVCSRTHKWCKYVF-{Amide} | 298 |
| [Tyr10]GpTx-1(1-34) | {H}-DCLGFMRKCYPDNDKCCRPNLVCSRTHKWCKYVF-{Amide} | 299 |
| [NMeTrp10]GpTx-1(1-34) | {H}-DCLGFMRKC[NMeTrp]PDNDKCCRPNLVCSRTHKWCKYVF-{Amide} | 300 |
| [Val10]GpTx-1(1-34) | {H}-DCLGFMRKCVPDNDKCCRPNLVCSRTHKWCKYVF-{Amide} | 301 |
| [Phe10]GpTx-1(1-34) | {H}-DCLGFMRKCFPDNDKCCRPNLVCSRTHKWCKYVF-{Amide} | 302 |
| [Leu10]GpTx-1(1-34) | {H}-DCLGFMRKCLPDNDKCCRPNLVCSRTHKWCKYVF-{Amide} | 303 |
| [His10]GpTx-1(1-34) | {H}-DCLGFMRKCHPDNDKCCRPNLVCSRTHKWCKYVF-{Amide} | 304 |
| [Ser10]GpTx-1(1-34) | {H}-DCLGFMRKCSPDNDKCCRPNLVCSRTHKWCKYVF-{Amide} | 305 |
| [Met10]GpTx-1(1-34) | {H}-DCLGFMRKCMPDNDKCCRPNLVCSRTHKWCKYVF-{Amide} | 307 |
| [Pro10]GpTx-1(1-34) | {H}-DCLGFMRKCPPDNDKCCRPNLVCSRTHKWCKYVF-{Amide} | 308 |
| [Thr10]GpTx-1(1-34) | {H}-DCLGFMRKCTPDNDKCCRPNLVCSRTHKWCKYVF-{Amide} | 309 |
| [4CO2-F10]GpTx-1(1-34) | {H}-DCLGFMRKC[4CO2-F]PDNDKCCRPNLVCSRTHKWCKYVF-{Amide} | 310 |
| [2PAL10]GpTx-1(1-34) | {H}-DCLGFMRKC[2PAL]PDNDKCCRPNLVCSRTHKWCKYVF-{Amide} | 311 |
| [SDMA15]GpTx-1(1-34) | {H}-DCLGFMRKCIPDND[SDMA]CCRPNLVCSRTHKWCKYVF-{Amide} | 312 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [K(Me2)15]GpTx-1(1-34) | {H}-DCLGFMRKCIPDND[K(Me2)]CCRPNLVCSRTHKWCKYVF-{Amide} | 313 |
| [K(Me2)18]GpTx-1(1-34) | {H}-DCLGFMRKCIPDNDKCC[K(Me2)]PNLVCSRTHKWCKYVF-{Amide} | 314 |
| [SDMA18]GpTx-1(1-34) | {H}-DCLGFMRKCIPDNDKCC[SDMA]PNLVCSRTHKWCKYVF-{Amide} | 315 |
| [2PAL18]GpTx-1(1-34) | {H}-DCLGFMRKCIPDNDKCC[2PAL]PNLVCSRTHKWCKYVF-{Amide} | 316 |
| [4CO2-F21]GpTx-1(1-34) | {H}-DCLGFMRKCIPDNDKCCRPN[4CO2-F]VCSRTHKWCKYVF-{Amide} | 317 |
| [2PAL21]GpTx-1(1-34) | {H}-DCLGFMRKCIPDNDKCCRPN[2PAL]VCSRTHKWCKYVF-{Amide} | 318 |
| [Phe22]GpTx-1(1-34) | {H}-DCLGFMRKCIPDNDKCCRPNLFCSRTHKWCKYVF-{Amide} | 319 |
| [Pro22]GpTx-1(1-34) | {H}-DCLGFMRKCIPDNDKCCRPNLPCSRTHKWCKYVF-{Amide} | 320 |
| [Ile22]GpTx-1(1-34) | {H}-DCLGFMRKCIPDNDKCCRPNLICSRTHKWCKYVF-{Amide} | 321 |
| [Leu22]GpTx-1(1-34) | {H}-DCLGFMRKCIPDNDKCCRPNLLCSRTHKWCKYVF-{Amide} | 322 |
| [Ser22]GpTx-1(1-34) | {H}-DCLGFMRKCIPDNDKCCRPNLSCSRTHKWCKYVF-{Amide} | 323 |
| [Gly22]GpTx-1(1-34) | {H}-DCLGFMRKCIPDNDKCCRPNLGCSRTHKWCKYVF-{Amide} | 324 |
| [Asn22]GpTx-1(1-34) | {H}-DCLGFMRKCIPDNDKCCRPNLNCSRTHKWCKYVF-{Amide} | 325 |
| [His22]GpTx-1(1-34) | {H}-DCLGFMRKCIPDNDKCCRPNLHCSRTHKWCKYVF-{Amide} | 326 |
| [Asp22]GpTx-1(1-34) | {H}-DCLGFMRKCIPDNDKCCRPNLDCSRTHKWCKYVF-{Amide} | 327 |
| [NMePhe22]GpTx-1(1-34) | {H}-DCLGFMRKCIPDNDKCCRPNL[NMePhe]CSRTHKWCKYVF-{Amide} | 328 |
| [Thr22]GpTx-1(1-34) | {H}-DCLGFMRKCIPDNDKCCRPNLTCSRTHKWCKYVF-{Amide} | 329 |
| [Phg22]GpTx-1(1-34) | {H}-DCLGFMRKCIPDNDKCCRPNL[Phg]CSRTHKWCKYVF-{Amide} | 330 |
| [Tyr22]GpTx-1(1-34) | {H}-DCLGFMRKCIPDNDKCCRPNLYCSRTHKWCKYVF-{Amide} | 331 |
| [Met22]GpTx-1(1-34) | {H}-DCLGFMRKCIPDNDKCCRPNLMCSRTHKWCKYVF-{Amide} | 332 |
| [4CO2-F22]GpTx-1(1-34) | {H}-DCLGFMRKCIPDNDKCCRPNL[4CO2-F]CSRTHKWCKYVF-{Amide} | 333 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [2PAL22]GpTx-1(1-34) | {H}-DCLGFMRKCIPDNDKCCRPNL[2PAL]CSRTHKWCKYVF-{Amide} | 334 |
| [K(Me2)25]GpTx-1(1-34) | {H}-DCLGFMRKCIPDNDKCCRPNLVCS[K(Me2)]THKWCKYVF-{Amide} | 335 |
| [SDMA25]GpTx-1(1-34) | {H}-DCLGFMRKCIPDNDKCCRPNLVCS[SDMA]THKWCKYVF-{Amide} | 336 |
| [His26]GpTx-1(1-34) | {H}-DCLGFMRKCIPDNDKCCRPNLVCSRHHKWCKYVF-{Amide} | 337 |
| [Ser26]GpTx-1(1-34) | {H}-DCLGFMRKCIPDNDKCCRPNLVCSRSHKWCKYVF-{Amide} | 338 |
| [Gln26]GpTx-1(1-34) | {H}-DCLGFMRKCIPDNDKCCRPNLVCSRQHKWCKYVF-{Amide} | 339 |
| [Tyr26]GpTx-1(1-34) | {H}-DCLGFMRKCIPDNDKCCRPNLVCSRYHKWCKYVF-{Amide} | 340 |
| [Phe26]GpTx-1(1-34) | {H}-DCLGFMRKCIPDNDKCCRPNLVCSRFHKWCKYVF-{Amide} | 341 |
| [Asn26]GpTx-1(1-34) | {H}-DCLGFMRKCIPDNDKCCRPNLVCSRNHKWCKYVF-{Amide} | 342 |
| [Gly26]GpTx-1(1-34) | {H}-DCLGFMRKCIPDNDKCCRPNLVCSRGHKWCKYVF-{Amide} | 343 |
| [Val26]GpTx-1(1-34) | {H}-DCLGFMRKCIPDNDKCCRPNLVCSRVHKWCKYVF-{Amide} | 344 |
| [Pro26]GpTx-1(1-34) | {H}-DCLGFMRKCIPDNDKCCRPNLVCSRPHKWCKYVF-{Amide} | 345 |
| [Met26]GpTx-1(1-34) | {H}-DCLGFMRKCIPDNDKCCRPNLVCSRMHKWCKYVF-{Amide} | 346 |
| [Asp26]GpTx-1(1-34) | {H}-DCLGFMRKCIPDNDKCCRPNLVCSRDHKWCKYVF-{Amide} | 347 |
| [Ile26]GpTx-1(1-34) | {H}-DCLGFMRKCIPDNDKCCRPNLVCSRIHKWCKYVF-{Amide} | 348 |
| [2PAL26]GpTx-1(1-34) | {H}-DCLGFMRKCIPDNDKCCRPNLVCSR[2PAL]HKWCKYVF-{Amide} | 349 |
| [4CO2-F26]GpTx-1(1-34) | {H}-DCLGFMRKCIPDNDKCCRPNLVCSR[4CO2-F]HKWCKYVF-{Amide} | 350 |
| [4CO2-F27]GpTx-1(1-34) | {H}-DCLGFMRKCIPDNDKCCRPNLVCSRT[4CO2-F]KWCKYVF-{Amide} | 351 |
| [2PAL27]GpTx-1(1-34) | {H}-DCLGFMRKCIPDNDKCCRPNLVCSRT[2PAL]KWCKYVF-{Amide} | 352 |
| [SDMA27]GpTx-1(1-34) | {H}-DCLGFMRKCIPDNDKCCRPNLVCSRT[SDMA]KWCKYVF-{Amide} | 353 |
| [K(Me2)27]GpTx-1(1-34) | {H}-DCLGFMRKCIPDNDKCCRPNLVCSRT[K(Me2)]KWCKYVF-{Amide} | 354 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [K(Me2)28]GpTx-1(1-34) | {H}-DCLGFMRKCIPDNDKCCRPNLVCSRTH[K(Me2)]WCKYVF-{Amide} | 355 |
| [SDMA28]GpTx-1(1-34) | {H}-DCLGFMRKCIPDNDKCCRPNLVCSRTH[SDMA]WCKYVF-{Amide} | 356 |
| [NMeTrp29]GpTx-1(1-34) | {H}-DCLGFMRKCIPDNDKCCRPNLVCSRTHK[NMeTrp]CKYVF-{Amide} | 357 |
| [pI-Phe29]GpTx-1(1-34) | {H}-DCLGFMRKCIPDNDKCCRPNLVCSRTHK[pI-Phe]CKYVF-{Amide} | 358 |
| [NMePhe29]GpTx-1(1-34) | {H}-DCLGFMRKCIPDNDKCCRPNLVCSRTHK[NMePhe]CKYVF-{Amide} | 359 |
| [Bip29]GpTx-1(1-34) | {H}-DCLGFMRKCIPDNDKCCRPNLVCSRTHK[Bip]CKYVF-{Amide} | 360 |
| [1'NMeW29]GpTx-1(1-34) | {H}-DCLGFMRKCIPDNDKCCRPNLVCSRTHK[1'NMeW]CKYVF-{Amide} | 361 |
| [Phg29]GpTx-1(1-34) | {H}-DCLGFMRKCIPDNDKCCRPNLVCSRTHK[Phg]CKYVF-{Amide} | 362 |
| [4CO2-F29]GpTx-1(1-34) | {H}-DCLGFMRKCIPDNDKCCRPNLVCSRTHK[4CO2-F]CKYVF-{Amide} | 363 |
| [2PAL31]GpTx-1(1-34) | {H}-DCLGFMRKCIPDNDKCCRPNLVCSRTHKWC[2PAL]YVF-{Amide} | 364 |
| [SDMA31]GpTx-1(1-34) | {H}-DCLGFMRKCIPDNDKCCRPNLVCSRTHKWC[SDMA]YVF-{Amide} | 365 |
| [Gln32]GpTx-1(1-34) | {H}-DCLGFMRKCIPDNDKCCRPNLVCSRTHKWCKQVF-{Amide} | 366 |
| [Ile32]GpTx-1(1-34) | {H}-DCLGFMRKCIPDNDKCCRPNLVCSRTHKWCKIVF-{Amide} | 367 |
| [Met32]GpTx-1(1-34) | {H}-DCLGFMRKCIPDNDKCCRPNLVCSRTHKWCKMVF-{Amide} | 368 |
| [Thr32]GpTx-1(1-34) | {H}-DCLGFMRKCIPDNDKCCRPNLVCSRTHKWCKTVF-{Amide} | 369 |
| [NMePhe32]GpTx-1(1-34) | {H}-DCLGFMRKCIPDNDKCCRPNLVCSRTHKWCK[NMePhe]VF-{Amide} | 370 |
| [NMeTrp32]GpTx-1(1-34) | {H}-DCLGFMRKCIPDNDKCCRPNLVCSRTHKWCK[NMeTrp]VF-{Amide} | 371 |
| [Val32]GpTx-1(1-34) | {H}-DCLGFMRKCIPDNDKCCRPNLVCSRTHKWCKVVF-{Amide} | 372 |
| [Leu32]GpTx-1(1-34) | {H}-DCLGFMRKCIPDNDKCCRPNLVCSRTHKWCKLVF-{Amide} | 373 |
| [Phg32]GpTx-1(1-34) | {H}-DCLGFMRKCIPDNDKCCRPNLVCSRTHKWCK[Phg]VF-{Amide} | 374 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Cha32]GpTx-1(1-34) | {H}-DCLGFMRKCIPDNDKCCRPNLVCSRTHKWCK[Cha]VF-{Amide} | 375 |
| [Bip32]GpTx-1(1-34) | {H}-DCLGFMRKCIPDNDKCCRPNLVCSRTHKWCK[Bip]VF-{Amide} | 376 |
| [Phe32]GpTx-1(1-34) | {H}-DCLGFMRKCIPDNDKCCRPNLVCSRTHKWCKFVF-{Amide} | 377 |
| [Gly32]GpTx-1(1-34) | {H}-DCLGFMRKCIPDNDKCCRPNLVCSRTHKWCKGVF-{Amide} | 378 |
| [Asn32]GpTx-1(1-34) | {H}-DCLGFMRKCIPDNDKCCRPNLVCSRTHKWCKNVF-{Amide} | 379 |
| [His32]GpTx-1(1-34) | {H}-DCLGFMRKCIPDNDKCCRPNLVCSRTHKWCKHVF-{Amide} | 380 |
| [pI-Phe32]GpTx-1(1-34) | {H}-DCLGFMRKCIPDNDKCCRPNLVCSRTHKWCK[pI-Phe]VF-{Amide} | 381 |
| [Ser32]GpTx-1(1-34) | {H}-DCLGFMRKCIPDNDKCCRPNLVCSRTHKWCKSVF-{Amide} | 382 |
| [Pro32]GpTx-1(1-34) | {H}-DCLGFMRKCIPDNDKCCRPNLVCSRTHKWCKPVF-{Amide} | 383 |
| [2PAL32]GpTx-1(1-34) | {H}-DCLGFMRKCIPDNDKCCRPNLVCSRTHKWCK[2PAL]VF-{Amide} | 384 |
| [4CO2-F32]GpTx-1(1-34) | {H}-DCLGFMRKCIPDNDKCCRPNLVCSRTHKWCK[4CO2-F]VF-{Amide} | 385 |
| [Cha33]GpTx-1(1-34) | {H}-DCLGFMRKCIPDNDKCCRPNLVCSRTHKWCKY[Cha]F-{Amide} | 386 |
| [NMePhe33]GpTx-1(1-34) | {H}-DCLGFMRKCIPDNDKCCRPNLVCSRTHKWCKY[NMePhe]F-{Amide} | 388 |
| [NMeTrp33]GpTx-1(1-34) | {H}-DCLGFMRKCIPDNDKCCRPNLVCSRTHKWCKY[NMeTrp]F-{Amide} | 389 |
| [Phe33]GpTx-1(1-34) | {H}-DCLGFMRKCIPDNDKCCRPNLVCSRTHKWCKYFF-{Amide} | 390 |
| [Met33]GpTx-1(1-34) | {H}-DCLGFMRKCIPDNDKCCRPNLVCSRTHKWCKYMF-{Amide} | 391 |
| [His33]GpTx-1(1-34) | {H}-DCLGFMRKCIPDNDKCCRPNLVCSRTHKWCKYHF-{Amide} | 392 |
| [Phg33]GpTx-1(1-34) | {H}-DCLGFMRKCIPDNDKCCRPNLVCSRTHKWCKY[Phg]F-{Amide} | 393 |
| [Asn33]GpTx-1(1-34) | {H}-DCLGFMRKCIPDNDKCCRPNLVCSRTHKWCKYNF-{Amide} | 394 |
| [Asp33]GpTx-1(1-34) | {H}-DCLGFMRKCIPDNDKCCRPNLVCSRTHKWCKYDF-{Amide} | 395 |
| [Thr33]GpTx-1(1-34) | {H}-DCLGFMRKCIPDNDKCCRPNLVCSRTHKWCKYTF-{Amide} | 396 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ser33]GpTx-1(1-34) | {H}-DCLGFMRKCIPDNDKCCRPNLVCSRTHKWCKYSF-{Amide} | 397 |
| [Pro33]GpTx-1(1-34) | {H}-DCLGFMRKCIPDNDKCCRPNLVCSRTHKWCKYPF-{Amide} | 398 |
| [Tyr33]GpTx-1(1-34) | {H}-DCLGFMRKCIPDNDKCCRPNLVCSRTHKWCKYYF-{Amide} | 399 |
| [Leu33]GpTx-1(1-34) | {H}-DCLGFMRKCIPDNDKCCRPNLVCSRTHKWCKYLF-{Amide} | 400 |
| [Gly33]GpTx-1(1-34) | {H}-DCLGFMRKCIPDNDKCCRPNLVCSRTHKWCKYGF-{Amide} | 401 |
| [2PAL33]GpTx-1(1-34) | {H}-DCLGFMRKCIPDNDKCCRPNLVCSRTHKWCKY[2PAL]F-{Amide} | 402 |
| [4CO2-F33]GpTx-1(1-34) | {H}-DCLGFMRKCIPDNDKCCRPNLVCSRTHKWCKY[4CO2-F]F-{Amide} | 403 |
| [D-Phe34]GpTx-1(1-34) | {H}-DCLGFMRKCIPDNDKCCRPNLVCSRTHKWCKYVf-{Amide} | 404 |
| [Cha34]GpTx-1(1-34) | {H}-DCLGFMRKCIPDNDKCCRPNLVCSRTHKWCKYV[Cha]-{Amide} | 405 |
| [Phg34]GpTx-1(1-34) | {H}-DCLGFMRKCIPDNDKCCRPNLVCSRTHKWCKYV[Phg]-{Amide} | 406 |
| [NMeTrp34]GpTx-1(1-34) | {H}-DCLGFMRKCIPDNDKCCRPNLVCSRTHKWCKYV[NMeTrp]-{Amide} | 407 |
| [NMePhe34]GpTx-1(1-34) | {H}-DCLGFMRKCIPDNDKCCRPNLVCSRTHKWCKYV[NMePhe]-{Amide} | 408 |
| [1'NMeW34]GpTx-1(1-34) | {H}-DCLGFMRKCIPDNDKCCRPNLVCSRTHKWCKYV[1'NMeW]-{Amide} | 409 |
| [4CO2-F34]GpTx-1(1-34) | {H}-DCLGFMRKCIPDNDKCCRPNLVCSRTHKWCKYV[4CO2-F]-{Amide} | 410 |
| [2PAL34]GpTx-1(1-34) | {H}-DCLGFMRKCIPDNDKCCRPNLVCSRTHKWCKYV[2PAL]-{Amide} | 411 |
| GpTx-1(1-34)-2-Nal | {H}-DCLGFMRKCIPDNDKCCRPNLVCSRTHKWCKYVF[2-Nal]-{Amide} | 412 |
| GpTx-1(1-34)-4CO2-F | {H}-DCLGFMRKCIPDNDKCCRPNLVCSRTHKWCKYVF[4CO2-F]-{Amide} | 413 |
| GpTx-1(1-34)-2PAL | {H}-DCLGFMRKCIPDNDKCCRPNLVCSRTHKWCKYVF[2PAL]-{Amide} | 414 |
| GpTx-1(1-33) | {H}-DCLGFMRKCIPDNDKCCRPNLVCSRTHKWCKYV-{Amide} | 415 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| GpTx-1(1-32) | {H}-DCLGFMRKCIPDNDKCCRPNLVCSRTHKWCKY-{Amide} | 416 |
| GpTx-1(1-31) | {H}-DCLGFMRKCIPDNDKCCRPNLVCSRTHKWCK-{Amide} | 417 |
| GpTx-1(1-30) | {H}-DCLGFMRKCIPDNDKCCRPNLVCSRTHKWC-{Amide} | 418 |
| [Ala5;Glu33]GpTx-1(1-34) | {H}-DCLGAMRKCIPDNDKCCRPNLVCSRTHKWCKYEF-{Amide} | 419 |
| [Ala5;Arg28;1-Nal33]GpTx-1(1-34) | {H}-DCLGAMRKCIPDNDKCCRPNLVCSRTHRWCKY[1-Nal]F-{Amide} | 420 |
| [Ala5;1-Nal20]GpTx-1(1-34) | {H}-DCLGAMRKCIPDNDKCCRP[1-Nal]LVCSRTHKWCKYVF-{Amide} | 421 |
| [Ala5;Trp20]GpTx-1(1-34) | {H}-DCLGAMRKCIPDNDKCCRPWLVCSRTHKWCKYVF-{Amide} | 422 |
| [Ala5;Trp12]GpTx-1(1-34) | {H}-DCLGAMRKCIPWNDKCCRPNLVCSRTHKWCKYVF-{Amide} | 423 |
| [Trp4;Ala5]GpTx-1(1-34) | {H}-DCLWAMRKCIPDNDKCCRPNLVCSRTHKWCKYVF-{Amide} | 424 |
| [1-Nal1;Ala5]GpTx-1(1-34) | {H}-[1-Nal]CLGAMRKCIPDNDKCCRPNLVCSRTHKWCKYVF-{Amide} | 425 |
| [Ala5,33]GpTx-1(1-34) | {H}-DCLGAMRKCIPDNDKCCRPNLVCSRTHKWCKYAF-{Amide} | 426 |
| [Ala5;1-Nal13]GpTx-1(1-34) | {H}-DCLGAMRKCIPD[1-Nal]DKCCRPNLVCSRTHKWCKYVF-{Amide} | 427 |
| [Ala5;Trp13]GpTx-1(1-34) | {H}-DCLGAMRKCIPDWDKCCRPNLVCSRTHKWCKYVF-{Amide} | 428 |
| [Glu4;Ala5]GpTx-1(1-34) | {H}-DCLEAMRKCIPDNDKCCRPNLVCSRTHKWCKYVF-{Amide} | 429 |
| [Ala5;Glu34]GpTx-1(1-34) | {H}-DCLGAMRKCIPDNDKCCRPNLVCSRTHKWCKYVE-{Amide} | 430 |
| [Ala5,34]GpTx-1(1-34) | {H}-DCLGAMRKCIPDNDKCCRPNLVCSRTHKWCKYVA-{Amide} | 431 |
| [Ala5,32]GpTx-1(1-34) | {H}-DCLGAMRKCIPDNDKCCRPNLVCSRTHKWCKAVF-{Amide} | 432 |
| [Ala5,31]GpTx-1(1-34) | {H}-DCLGAMRKCIPDNDKCCRPNLVCSRTHKWCAYVF-{Amide} | 433 |
| [Ala5,29]GpTx-1(1-34) | {H}-DCLGAMRKCIPDNDKCCRPNLVCSRTHKACKYVF-{Amide} | 434 |
| [Ala5;Glu28]GpTx-1(1-34) | {H}-DCLGAMRKCIPDNDKCCRPNLVCSRTHEWCKYVF-{Amide} | 435 |
| [Ala5;Glu7]GpTx-1(1-34) | {H}-DCLGAMEKCIPDNDKCCRPNLVCSRTHKWCKYVF-{Amide} | 436 |
| [Ala5;Glu29]GpTx-1(1-34) | {H}-DCLGAMRKCIPDNDKCCRPNLVCSRTHKECKYVF-{Amide} | 437 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Glu25]GpTx-1(1-34) | {H}-DCLGAMRKCIPDNDKCCRPNLVCSETHKWCKYVF-{Amide} | 438 |
| [Ala5;Glu15]GpTx-1(1-34) | {H}-DCLGAMRKCIPDNDECCRPNLVCSRTHKWCKYVF-{Amide} | 439 |
| [1-Nal10;Trp32]GpTx-1(1-34) | {H}-DCLGFMRKC[1-Nal]PDNDKCCRPNLVCSRTHKWCKWVF-{Amide} | 440 |
| [1-Nal10;Arg28]GpTx-1(1-34) | {H}-DCLGFMRKC[1-Nal]PDNDKCCRPNLVCSRTHRWCKYVF-{Amide} | 441 |
| [Arg28;1-Nal33]GpTx-1(1-34) | {H}-DCLGFMRKCIPDNDKCCRPNLVCSRTHRWCKY[1-Nal]F-{Amide} | 442 |
| [Arg28;Trp32]GpTx-1(1-34) | {H}-DCLGFMRKCIPDNDKCCRPNLVCSRTHRWCKWVF-{Amide} | 443 |
| [Arg28;Trp33]GpTx-1(1-34) | {H}-DCLGFMRKCIPDNDKCCRPNLVCSRTHRWCKYWF-{Amide} | 444 |
| [Leu26;Arg28]GpTx-1(1-34) | {H}-DCLGFMRKCIPDNDKCCRPNLVCSRLHRWCKYVF-{Amide} | 445 |
| [Leu26;Trp32]GpTx-1(1-34) | {H}-DCLGFMRKCIPDNDKCCRPNLVCSRLHKWCKWVF-{Amide} | 446 |
| [Leu26;Trp33]GpTx-1(1-34) | {H}-DCLGFMRKCIPDNDKCCRPNLVCSRLHKWCKYWF-{Amide} | 447 |
| [Trp6;Arg28]GpTx-1(1-34) | {H}-DCLGFWRKCIPDNDKCCRPNLVCSRTHRWCKYVF-{Amide} | 448 |
| [Trp6,32]GpTx-1(1-34) | {H}-DCLGFWRKCIPDNDKCCRPNLVCSRTHKWCKWVF-{Amide} | 449 |
| [Trp32,33]GpTx-1(1-34) | {H}-DCLGFMRKCIPDNDKCCRPNLVCSRTHKWCKWWF-{Amide} | 450 |
| [1-Nal6;Trp32]GpTx-1(1-34) | {H}-DCLGF[1-Nal]RKCIPDNDKCCRPNLVCSRTHKWCKWVF-{Amide} | 451 |
| [1-Nal10,32]GpTx-1(1-34) | {H}-DCLGFMRKC[1-Nal]PDNDKCCRPNLVCSRTHKWCK[1-Nal]VF-{Amide} | 452 |
| [Leu26;1-Nal32]GpTx-1(1-34) | {H}-DCLGFMRKCIPDNDKCCRPNLVCSRLHKWCK[1-Nal]VF-{Amide} | 453 |
| [1-Nal6;Arg28]GpTx-1(1-34) | {H}-DCLGF[1-Nal]RKCIPDNDKCCRPNLVCSRTHRWCKYVF-{Amide} | 454 |
| [Trp32;1-Nal33]GpTx-1(1-34) | {H}-DCLGFMRKCIPDNDKCCRPNLVCSRTHKWCKW[1-Nal]F-{Amide} | 455 |
| [Trp6;Leu26]GpTx-1(1-34) | {H}-DCLGFWRKCIPDNDKCCRPNLVCSRLHKWCKYVF-{Amide} | 456 |
| [1-Nal10;Leu26]GpTx-1(1-34) | {H}-DCLGFMRKC[1-Nal]PDNDKCCRPNLVCSRLHKWCKYVF-{Amide} | 457 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Trp6;1-Nal10]GpTx-1(1-34) | {H}-DCLGFWRKC[1-Nal]PDNDKCCRPNLVCSRTHKWCKYVF-{Amide} | 458 |
| [1-Nal10;Trp12]GpTx-1(1-34) | {H}-DCLGFMRKC[1-Nal]PWNDKCCRPNLVCSRTHKWCKYVF-{Amide} | 459 |
| [1-Nal32;Trp33]GpTx-1(1-34) | {H}-DCLGFMRKCIPDNDKCCRPNLVCSRTHKWCK[1-Nal]WF-{Amide} | 460 |
| [Trp6;1-Nal33]GpTx-1(1-34) | {H}-DCLGFWRKCIPDNDKCCRPNLVCSRTHKWCKY[1-Nal]F-{Amide} | 461 |
| [1-Nal10,33]GpTx-1(1-34) | {H}-DCLGFMRKC[1-Nal]PDNDKCCRPNLVCSRTHKWCKY[1-Nal]F-{Amide} | 462 |
| [Leu26;1-Nal33]GpTx-1(1-34) | {H}-DCLGFMRKCIPDNDKCCRPNLVCSRLHKWCKY[1-Nal]F-{Amide} | 463 |
| Trp-[1-Nal10]GpTx-1(1-34) | {H}-WDCLGFMRKC[1-Nal]PDNDKCCRPNLVCSRTHKWCKYVF-{Amide} | 464 |
| [Trp1;1-Nal10]GpTx-1(1-34) | {H}-WCLGFMRKC[1-Nal]PDNDKCCRPNLVCSRTHKWCKYVF-{Amide} | 465 |
| [1-Nal1,10]GpTx-1(1-34) | {H}[1-Nal]CLGFMRKC[1-Nal]PDNDKCCRPNLVCSRTHKWCKYVF-{Amide} | 466 |
| GpTx-2 | {H}-DCLGFMRKCSPDNDKCCRPNLVCSRKHKWCKYEI-{Amide} | 467 |
| GpTx-3 | {H}-DCLGWFKGCDPDNDKCCEGYKCNRRDKWCKYKL-{Amide} | 468 |
| GpTx-4 | {H}-DCLGWFKGCDPDNDKCCENYKCNRREQWCKYKL-{Amide} | 469 |
| GpTx-5(1-35) | {H}-DCLGFMRKCIPDNDKCCRPNLVCSRTHKWCKYVFK-{FreeAcid} | 470 |
| GpTx-6(1-35) | {H}-DCLGWFKGCDPDNDKCCEGYKCNRRDKWCKYKLWK-{FreeAcid} | 471 |
| GpTx-6(1-34) | {H}-DCLGWFKGCDPDNDKCCEGYKCNRRDKWCKYKLW-{FreeAcid} | 472 |
| GpTx-7(1-35) | {H}-DCLGWFKGCDPDNDKCCENYKCNRRDKWCKYKLWK-{FreeAcid} | 473 |
| GpTx-7(1-34) | {H}-DCLGWFKGCDPDNDKCCENYKCNRRDKWCKYKLW-{FreeAcid} | 474 |
| [Phe6;Atz(20kDa PEG)13]GpTx-1(1-34) | {H}-DCLGFFRKCIPD[Atz(20kDa PEG)]DKCCRPNLVCSRTHKWCKYVF-{Amide} | 590 |
| [Phe6;Atz13]GpTx-1(1-34) | DCLGFFRKCIPD[Atz]DKCCRPNLVCSRTHKWCKYVF{Amide} | 591 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Phe6,Atz(20kDa Peg)28]GpTx-1(1-34) | {H}-DCLGFFRKCIPDNDKCCRPNLVCSRTH[Atz(20kDa PEG)]WCKYVF-{Amide} | 593 |
| [Phe6,Atz(20kDa Peg)22]GpTx-1(1-34) | {H}-DCLGFFRKCIPDNDKCCRPNL[Atz(20kDa PEG)]CSRTHKWCKYVF-{Amide} | 594 |
| [1-Nal10;Glu29]GpTx-1(1-34) | {H}-DCLGFMRKC[1-Nal]PDNDKCCRPNLVCSRTHKECKYVF-{Amide} | 595 |
| [3Pal5]GpTx-1(1-34) | {H}-DCLG[3Pal]MRKCIPDNDKCCRPNLVCSRTHKWCKYVF-{Amide} | 596 |
| [Ala5;Phe6;Tyr13;Arg28]GpTx-1(1-34)-FreeAcid | {H}-DCLGAFRKCIPDYDKCCRPNLVCSRTHRWCKYVF-{FreeAcid} | 597 |
| [Ala5;Leu6;Gly28]GpTx-1(1-34)-FreeAcid | {H}-DCLGALRKCIPDNDKCCRPNLVCSRTHGWCKYVF-{FreeAcid} | 598 |
| [Ala5;Leu6;His28]GpTx-1(1-34)-FreeAcid | {H}-DCLGALRKCIPDNDKCCRPNLVCSRTHHWCKYVF-{FreeAcid} | 599 |
| [Ala5;Leu6]GpTx-1(1-34)-FreeAcid | {H}-DCLGALRKCIPDNDKCCRPNLVCSRTHKWCKYVF-{FreeAcid} | 600 |
| [Ala5;Leu6;Asn28]GpTx-1(1-34)-FreeAcid | {H}-DCLGALRKCIPDNDKCCRPNLVCSRTHNWCKYVF-{FreeAcid} | 601 |
| [D-Ala5;Phe6]GpTx-1(1-34) | {H}-DCLGaFRKCIPDNDKCCRPNLVCSRTHKWCKYVF-{Amide} | 602 |
| [bAla5;Phe6]GpTx-1(1-34) | {H}-DCLG[bAla]FRKCIPDNDKCCRPNLVCSRTHKWCKYVF-{Amide} | 603 |
| [Aib5;Phe6]GpTx-1(1-34) | {H}-DCLG[Aib]FRKCIPDNDKCCRPNLVCSRTHKWCKYVF-{Amide} | 604 |
| [2-Abu5;Phe6]GpTx-1(1-34) | {H}-DCLG[2-Abu]FRKCIPDNDKCCRPNLVCSRTHKWCKYVF-{Amide} | 605 |
| [Nva5;Phe6]GpTx-1(1-34) | {H}-DCLG[Nva]FRKCIPDNDKCCRPNLVCSRTHKWCKYVF-{Amide} | 606 |
| [Nle5;Phe6]GpTx-1(1-34) | {H}-DCLG[Nle]FRKCIPDNDKCCRPNLVCSRTHKWCKYVF-{Amide} | 607 |
| [OctylG5;Phe6]GpTx-1(1-34) | {H}-DCLG[OctylG]FRKCIPDNDKCCRPNLVCSRTHKWCKYVF-{Amide} | 608 |
| [Tle5;Phe6]GpTx-1(1-34) | {H}-DCLG[Tle]FRKCIPDNDKCCRPNLVCSRTHKWCKYVF-{Amide} | 609 |
| [hLeu5;Phe6]GpTx-1(1-34) | {H}-DCLG[hLeu]FRKCIPDNDKCCRPNLVCSRTHKWCKYVF-{Amide} | 610 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Met5;Phe6]GpTx-1(1-34) | {H}-DCLGMFRKCIPDNDKCCRPNLVCSRTHKWCKYVF-{Amide} | 611 |
| [Leu5;Phe6]GpTx-1(1-34) | {H}-DCLGLFRKCIPDNDKCCRPNLVCSRTHKWCKYVF-{Amide} | 612 |
| [3Pal5;Phe6]GpTx-1(1-34) | {H}-DCLG[3Pal]FRKCIPDNDKCCRPNLVCSRTHKWCKYVF-{Amide} | 613 |
| [Thi5;Phe6]GpTx-1(1-34) | {H}-DCLG[Thi]FRKCIPDNDKCCRPNLVCSRTHKWCKYVF-{Amide} | 614 |
| [Cpg5;Phe6]GpTx-1(1-34) | {H}-DCLG[Cpg]FRKCIPDNDKCCRPNLVCSRTHKWCKYVF-{Amide} | 615 |
| [Chg5;Phe6]GpTx-1(1-34) | {H}-DCLG[Chg]FRKCIPDNDKCCRPNLVCSRTHKWCKYVF-{Amide} | 616 |
| [Ser5;Phe6]GpTx-1(1-34) | {H}-DCLGSFRKCIPDNDKCCRPNLVCSRTHKWCKYVF-{Amide} | 617 |
| [Val5;Phe6]GpTx-1(1-34) | {H}-DCLGVFRKCIPDNDKCCRPNLVCSRTHKWCKYVF-{Amide} | 618 |
| [4-Bz-F5;Phe6]GpTx-1(1-34) | {H}-DCLG[4-Bz-F]FRKCIPDNDKCCRPNLVCSRTHKWCKYVF-{Amide} | 619 |
| [DiMeO-F5;Phe6]GpTx-1(1-34) | {H}-DCLG[DiMeO-F]FRKCIPDNDKCCRPNLVCSRTHKWCKYVF-{Amide} | 620 |
| [DiCl-F5;Phe6]GpTx-1(1-34) | {H}-DCLG[DiCl-F]FRKCIPDNDKCCRPNLVCSRTHKWCKYVF-{Amide} | 621 |
| [pI-Phe5;Phe6]GpTx-1(1-34) | {H}-DCLG[pI-Phe]FRKCIPDNDKCCRPNLVCSRTHKWCKYVF-{Amide} | 622 |
| [4CF3-F5;Phe6]GpTx-1(1-34) | {H}-DCLG[4CF3-F]FRKCIPDNDKCCRPNLVCSRTHKWCKYVF-{Amide} | 623 |
| [4-F-F5;Phe6]GpTx-1(1-34) | {H}-DCLG[4-F-F]FRKCIPDNDKCCRPNLVCSRTHKWCKYVF-{Amide} | 624 |
| [4-Me-F5;Phe6]GpTx-1(1-34) | {H}-DCLG[4-Me-F]FRKCIPDNDKCCRPNLVCSRTHKWCKYVF-{Amide} | 625 |
| [4tBu-F5;Phe6]GpTx-1(1-34) | {H}-DCLG[4tBu-F]FRKCIPDNDKCCRPNLVCSRTHKWCKYVF-{Amide} | 626 |
| [NMeVal5;Phe6]GpTx-1(1-34) | {H}-DCLG[NMeVal]FRKCIPDNDKCCRPNLVCSRTHKWCKYVF-{Amide} | 627 |
| [NMeLeu5;Phe6]GpTx-1(1-34) | {H}-DCLG[NMeLeu]FRKCIPDNDKCCRPNLVCSRTHKWCKYVF-{Amide} | 628 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [NMePhe5;Phe6]GpTx-1(1-34) | {H}-DCLG[NMePhe]FRKCIPDNDKCCRPNLVCSRTHKWCKYVF-{Amide} | 629 |
| [2-Cl-F5;Phe6]GpTx-1(1-34) | {H}-DCLG[2-Cl-F]FRKCIPDNDKCCRPNLVCSRTHKWCKYVF-{Amide} | 630 |
| [hPhe5;Phe6]GpTx-1(1-34) | {H}-DCLG[hPhe]FRKCIPDNDKCCRPNLVCSRTHKWCKYVF-{Amide} | 631 |
| [Sar5;Phe6]GpTx-1(1-34) | {H}-DCLG[Sar]FRKCIPDNDKCCRPNLVCSRTHKWCKYVF-{Amide} | 632 |
| [D-Ala5;Leu6]GpTx-1(1-34) | {H}-DCLGaLRKCIPDNDKCCRPNLVCSRTHKWCKYVF-{Amide} | 633 |
| [bAla5;Leu6]GpTx-1(1-34) | {H}-DCLG[bAla]LRKCIPDNDKCCRPNLVCSRTHKWCKYVF-{Amide} | 634 |
| [Aib5;Leu6]GpTx-1(1-34) | {H}-DCLG[Aib]LRKCIPDNDKCCRPNLVCSRTHKWCKYVF-{Amide} | 635 |
| [2-Abu5;Leu6]GpTx-1(1-34) | {H}-DCLG[2-Abu]LRKCIPDNDKCCRPNLVCSRTHKWCKYVF-{Amide} | 636 |
| [Nva5;Leu6]GpTx-1(1-34) | {H}-DCLG[Nva]LRKCIPDNDKCCRPNLVCSRTHKWCKYVF-{Amide} | 637 |
| [Nle5;Leu6]GpTx-1(1-34) | {H}-DCLG[Nle]LRKCIPDNDKCCRPNLVCSRTHKWCKYVF-{Amide} | 638 |
| [Octy1G5;Leu6]GpTx-1(1-34) | {H}-DCLG[OctylG]LRKCIPDNDKCCRPNLVCSRTHKWCKYVF-{Amide} | 639 |
| [Ala5,Phe6,Pra13,Leu26,Arg28]GpTx-1(1-34) | {H}-DCLGAFRKCIPD[Pra]DKCCRPNLVCSRLHRWCKYVF-{Amide} | 640 |
| [Met5;Leu6]GpTx-1(1-34) | {H}-DCLGMLRKCIPDNDKCCRPNLVCSRTHKWCKYVF-{Amide} | 641 |
| [3Pal5;Leu6]GpTx-1(1-34) | {H}-DCLG[3Pal]LRKCIPDNDKCCRPNLVCSRTHKWCKYVF-{Amide} | 642 |
| [Ser5;Leu6]GpTx-1(1-34) | {H}-DCLGSLRKCIPDNDKCCRPNLVCSRTHKWCKYVF-{Amide} | 643 |
| [Val5;Leu6]GpTx-1(1-34) | {H}-DCLGVLRKCIPDNDKCCRPNLVCSRTHKWCKYVF-{Amide} | 644 |
| [DiMeO-F5;Leu6]GpTx-1(1-34) | {H}-DCLG[DiMeO-F]LRKCIPDNDKCCRPNLVCSRTHKWCKYVF-{Amide} | 645 |
| [Sar5;Leu6]GpTx-1(1-34) | {H}-DCLG[Sar]LRKCIPDNDKCCRPNLVCSRTHKWCKYVF-{Amide} | 646 |
| [D-Ala5]GpTx-1(1-34) | {H}-DCLGaMRKCIPDNDKCCRPNLVCSRTHKWCKYVF-{Amide} | 647 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [bAla5]GpTx-1(1-34) | {H}-DCLG[bAla]MRKCIPDNDKCCRPNLVCSRTHKWCKYVF-{Amide} | 648 |
| [2-Abu5]GpTx-1(1-34) | {H}-DCLG[2-Abu]MRKCIPDNDKCCRPNLVCSRTHKWCKYVF-{Amide} | 649 |
| [Nva5]GpTx-1(1-34) | {H}-DCLG[Nva]MRKCIPDNDKCCRPNLVCSRTHKWCKYVF-{Amide} | 650 |
| [Nle5]GpTx-1(1-34) | {H}-DCLG[Nle]MRKCIPDNDKCCRPNLVCSRTHKWCKYVF-{Amide} | 651 |
| [DiMeO-F5]GpTx-1(1-34) | {H}-DCLG[DiMeO-F]MRKCIPDNDKCCRPNLVCSRTHKWCKYVF-{Amide} | 652 |
| [DiCl-F5]GpTx-1(1-34) | {H}-DCLG[DiCl-F]MRKCIPDNDKCCRPNLVCSRTHKWCKYVF-{Amide} | 653 |
| [4CF3-F5]GpTx-1(1-34) | {H}-DCLG[4CF3-F]MRKCIPDNDKCCRPNLVCSRTHKWCKYVF-{Amide} | 654 |
| [4-F-F5]GpTx-1(1-34) | {H}-DCLG[4-F-F]MRKCIPDNDKCCRPNLVCSRTHKWCKYVF-{Amide} | 655 |
| [NMeVal5]GpTx-1(1-34) | {H}-DCLG[NMeVal]MRKCIPDNDKCCRPNLVCSRTHKWCKYVF-{Amide} | 656 |
| [NMePhe5]GpTx-1(1-34) | {H}-DCLG[NMePhe]MRKCIPDNDKCCRPNLVCSRTHKWCKYVF-{Amide} | 657 |
| [Sar5]GpTx-1(1-34) | {H}-DCLG[Sar]MRKCIPDNDKCCRPNLVCSRTHKWCKYVF-{Amide} | 658 |
| [Tle5;Leu6]GpTx-1(1-34) | {H}-DCLG[Tle]LRKCIPDNDKCCRPNLVCSRTHKWCKYVF-{Amide} | 659 |
| [hLeu5;Leu6]GpTx-1(1-34) | {H}-DCLG[hLeu]LRKCIPDNDKCCRPNLVCSRTHKWCKYVF-{Amide} | 660 |
| [Leu5,6]GpTx-1(1-34) | {H}-DCLGLLRKCIPDNDKCCRPNLVCSRTHKWCKYVF-{Amide} | 661 |
| [Thi5;Leu6]GpTx-1(1-34) | {H}-DCLG[Thi]LRKCIPDNDKCCRPNLVCSRTHKWCKYVF-{Amide} | 662 |
| [Cpg5;Leu6]GpTx-1(1-34) | {H}-DCLG[Cpg]LRKCIPDNDKCCRPNLVCSRTHKWCKYVF-{Amide} | 663 |
| [Chg5;Leu6]GpTx-1(1-34) | {H}-DCLG[Chg]LRKCIPDNDKCCRPNLVCSRTHKWCKYVF-{Amide} | 664 |
| [4-Bz-F5;Leu6]GpTx-1(1-34) | {H}-DCLG[4-Bz-F]LRKCIPDNDKCCRPNLVCSRTHKWCKYVF-{Amide} | 665 |
| [DiCl-F5;Leu6]GpTx-1(1-34) | {H}-DCLG[DiCl-F]LRKCIPDNDKCCRPNLVCSRTHKWCKYVF-{Amide} | 666 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [pI-Phe5;Leu6]GpTx-1(1-34) | {H}-DCLG[pI-Phe]LRKCIPDNDKCCRPNLVCSRTHKWCKYVF-{Amide} | 667 |
| [4CF3-F5;Leu6]GpTx-1(1-34) | {H}-DCLG[4CF3-F]LRKCIPDNDKCCRPNLVCSRTHKWCKYVF-{Amide} | 668 |
| [4-F-F5;Leu6]GpTx-1(1-34) | {H}-DCLG[4-F-F]LRKCIPDNDKCCRPNLVCSRTHKWCKYVF-{Amide} | 669 |
| [4-Me-F5;Leu6]GpTx-1(1-34) | {H}-DCLG[4-Me-F]LRKCIPDNDKCCRPNLVCSRTHKWCKYVF-{Amide} | 670 |
| [4tBu-F5;Leu6]GpTx-1(1-34) | {H}-DCLG[4tBu-F]LRKCIPDNDKCCRPNLVCSRTHKWCKYVF-{Amide} | 671 |
| [NMeVal5;Leu6]GpTx-1(1-34) | {H}-DCLG[NMeVal]LRKCIPDNDKCCRPNLVCSRTHKWCKYVF-{Amide} | 672 |
| [NMeLeu5;Leu6]GpTx-1(1-34) | {H}-DCLG[NMeLeu]LRKCIPDNDKCCRPNLVCSRTHKWCKYVF-{Amide} | 673 |
| [NMePhe5;Leu6]GpTx-1(1-34) | {H}-DCLG[NMePhe]LRKCIPDNDKCCRPNLVCSRTHKWCKYVF-{Amide} | 674 |
| [2-Cl-F5;Leu6]GpTx-1(1-34) | {H}-DCLG[2-Cl-F]LRKCIPDNDKCCRPNLVCSRTHKWCKYVF-{Amide} | 675 |
| [hPhe5;Leu6]GpTx-1(1-34) | {H}-DCLG[hPhe]LRKCIPDNDKCCRPNLVCSRTHKWCKYVF-{Amide} | 676 |
| [OctylG5]GpTx-1(1-34) | {H}-DCLG[OctylG]MRKCIPDNDKCCRPNLVCSRTHKWCKYVF-{Amide} | 677 |
| [Tle5]GpTx-1(1-34) | {H}-DCLG[Tle]MRKCIPDNDKCCRPNLVCSRTHKWCKYVF-{Amide} | 678 |
| [hLeu5]GpTx-1(1-34) | {H}-DCLG[hLeu]MRKCIPDNDKCCRPNLVCSRTHKWCKYVF-{Amide} | 679 |
| [Cha5;Phe6]GpTx-1(1-34) | {H}-DCLG[Cha]FRKCIPDNDKCCRPNLVCSRTHKWCKYVF-{Amide} | 680 |
| [Cha5;Leu6]GpTx-1(1-34) | {H}-DCLG[Cha]LRKCIPDNDKCCRPNLVCSRTHKWCKYVF-{Amide} | 681 |
| [Thi5]GpTx-1(1-34) | {H}-DCLG[Thi]MRKCIPDNDKCCRPNLVCSRTHKWCKYVF-{Amide} | 682 |
| [Cpg5]GpTx-1(1-34) | {H}-DCLG[Cpg]MRKCIPDNDKCCRPNLVCSRTHKWCKYVF-{Amide} | 683 |
| [Chg5]GpTx-1(1-34) | {H}-DCLG[Chg]MRKCIPDNDKCCRPNLVCSRTHKWCKYVF-{Amide} | 684 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [4-Bz-F5]GpTx-1(1-34) | {H}-DCLG[4-Bz-F]MRKCIPDNDKCCRPNLVCSRTHKWCKYVF-{Amide} | 685 |
| [4-Me-F5]GpTx-1(1-34) | {H}-DCLG[4-Me-F]MRKCIPDNDKCCRPNLVCSRTHKWCKYVF-{Amide} | 686 |
| [4tBu-F5]GpTx-1(1-34) | {H}-DCLG[4tBu-F]MRKCIPDNDKCCRPNLVCSRTHKWCKYVF-{Amide} | 687 |
| [NMeLeu5]GpTx-1(1-34) | {H}-DCLG[NMeLeu]MRKCIPDNDKCCRPNLVCSRTHKWCKYVF-{Amide} | 688 |
| [2-Cl-F5]GpTx-1(1-34) | {H}-DCLG[2-Cl-F]MRKCIPDNDKCCRPNLVCSRTHKWCKYVF-{Amide} | 689 |
| [hPhe5]GpTx-1(1-34) | {H}-DCLG[hPhe]MRKCIPDNDKCCRPNLVCSRTHKWCKYVF-{Amide} | 690 |
| [Ala5;Glu28]GpTx-1(1-34) | {H}-DCLGAMRKCIPDNDKCCRPNLVCSRTHEWCKYVF-{Amide} | 691 |
| [Ala5;1'NMeW32]GpTx-1(1-34) | {H}-DCLGAMRKCIPDNDKCCRPNLVCSRTHKWCK[1'NMeW]VF-{Amide} | 692 |
| [Met5;1'NMeW32]GpTx-1(1-34) | {H}-DCLGMMRKCIPDNDKCCRPNLVCSRTHKWCK[1'NMeW]VF-{Amide} | 693 |
| [Arg4;Met5]GpTx-1(1-34) | {H}-DCLRMMRKCIPDNDKCCRPNLVCSRTHKWCKYVF-{Amide} | 694 |
| [Ser19;1'NMeW32]GpTx-1(1-34) | {H}-DCLGFMRKCIPDNDKCCRSNLVCSRTHKWCK[1'NMeW]VF-{Amide} | 695 |
| [Ala5;Leu6]GpTx-1(1-34) | {H}-DCLGALRKCIPDNDKCCRPNLVCSRTHKWCKYVF-{Amide} | 696 |
| [Ala5;Gly6]GpTx-1(1-34) | {H}-DCLGAGRKCIPDNDKCCRPNLVCSRTHKWCKYVF-{Amide} | 697 |
| [Ala5;Tyr6]GpTx-1(1-34) | {H}-DCLGAYRKCIPDNDKCCRPNLVCSRTHKWCKYVF-{Amide} | 698 |
| [Ala5;1'NMeW6]GpTx-1(1-34) | {H}-DCLGA[1'NMeW]RKCIPDNDKCCRPNLVCSRTHKWCKYVF-{Amide} | 699 |
| [Ala5;Asp10]GpTx-1(1-34) | {H}-DCLGAMRKCDPDNDKCCRPNLVCSRTHKWCKYVF-{Amide} | 700 |
| [Ala5;Asp10;Glu12]GpTx-1(1-34) | {H}-DCLGAMRKCDPENDKCCRPNLVCSRTHKWCKYVF-{Amide} | 701 |
| [Ala5;Phe6;Asp10]GpTx-1(1-34) | {H}-DCLGAFRKCDPDNDKCCRPNLVCSRTHKWCKYVF-{Amide} | 702 |
| [Ala5;Phe6;Glu12]GpTx-1(1-34) | {H}-DCLGAFRKCIPENDKCCRPNLVCSRTHKWCKYVF-{Amide} | 703 |
| [Val5;Glu28]GpTx-1(1-34) | {H}-DCLGVMRKCIPDNDKCCRPNLVCSRTHEWCKYVF-{Amide} | 704 |
| [Nva5;Glu28]GpTx-1(1-34) | {H}-DCLG[Nva]MRKCIPDNDKCCRPNLVCSRTHEWCKYVF-{Amide} | 705 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [2-Abu5;Glu28]GpTx-1(1-34) | {H}-DCLG[2-Abu]MRKCIPDNDKCCRPNLVCSRTHEWCKYVF-{Amide} | 706 |
| [2-Abu5;Leu6;Glu28]GpTx-1(1-34) | {H}-DCLG[2-Abu]LRKCIPDNDKCCRPNLVCSRTHEWCKYVF-{Amide} | 707 |
| [Nva5;Leu6;Glu28]GpTx-1(1-34) | {H}-DCLG[Nva]LRKCIPDNDKCCRPNLVCSRTHEWCKYVF-{Amide} | 708 |
| [Val5;Leu6;Glu28]GpTx-1(1-34) | {H}-DCLGVLRKCIPDNDKCCRPNLVCSRTHEWCKYVF-{Amide} | 709 |
| [Val5;Asp10]GpTx-1(1-34) | {H}-DCLGVMRKCDPDNDKCCRPNLVCSRTHKWCKYVF-{Amide} | 710 |
| [Val5;Glu12]GpTx-1(1-34) | {H}-DCLGVMRKCIPENDKCCRPNLVCSRTHKWCKYVF-{Amide} | 711 |
| [Val5;Asp10;Glu12]GpTx-1(1-34) | {H}-DCLGVMRKCDPENDKCCRPNLVCSRTHKWCKYVF-{Amide} | 712 |
| [Val5;Cit25]GpTx-1(1-34) | {H}-DCLGVMRKCIPDNDKCCRPNLVCS[Cit]THKWCKYVF-{Amide} | 713 |
| [Thr5;Asp10]GpTx-1(1-34) | {H}-DCLGTMRKCDPDNDKCCRPNLVCSRTHKWCKYVF-{Amide} | 714 |
| [Ala5;Gly28]GpTx-1(1-34) | {H}-DCLGAMRKCIPDNDKCCRPNLVCSRTHGWCKYVF-{Amide} | 715 |
| [2-Abu2,17;Ala5;Asp10]GpTx-1(1-34) | {H}-D[2-Abu]LGAMRKCDPDNDKC[2-Abu]RPNLVCSRTHKWCKYVF-{Amide} | 716 |
| [2-Abu2,17;Nva5;Leu6;Glu28]GpTx-1(1-34) | {H}-D[2-Abu]LG[Nva]LRKCIPDNDKC[2-Abu]RPNLVCSRTHEWCKYVF-{Amide} | 717 |
| [2-Abu2,5,17;Leu6;Glu28]GpTx-1(1-34) | {H}-D[2-Abu]LG[2-Abu]LRKCIPDNDKC[2-Abu]RPNLVCSRTHEWCKYVF-{Amide} | 718 |
| [2-Abu2,17;Ala5;Leu6;Glu28]GpTx-1(1-34) | {H}-D[2-Abu]LGALRKCIPDNDKC[2-Abu]RPNLVCSRTHEWCKYVF-{Amide} | 719 |
| [2-Abu2,17;Val5;Leu6;Glu28]GpTx-1(1-34) | {H}-D[2-Abu]LGVLRKCIPDNDKC[2-Abu]RPNLVCSRTHEWCKYVF-{Amide} | 720 |
| [Ala5;Nle6]GpTx-1(1-34) | {H}-DCLGA[Nle]RKCIPDNDKCCRPNLVCSRTHKWCKYVF-{Amide} | 721 |
| [Ala5;Nle6;Glu10]GpTx-1(1-34) | {H}-DCLGA[Nle]RKCEPDNDKCCRPNLVCSRTHKWCKYVF-{Amide} | 722 |
| [Ala5;Leu6;Glu10]GpTx-1(1-34) | {H}-DCLGALRKCEPDNDKCCRPNLVCSRTHKWCKYVF-{Amide} | 723 |
| [Ala5;Phe6;Glu10]GpTx-1(1-34) | {H}-DCLGAFRKCEPDNDKCCRPNLVCSRTHKWCKYVF-{Amide} | 724 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Nle6;Glu12]GpTx-1(1-34) | {H}-DCLGA[Nle]RKCIPENDKCCRPNLVCSRTHKWCKYVF-{Amide} | 725 |
| [Ala5;Leu6;Glu12]GpTx-1(1-34) | {H}-DCLGALRKCIPENDKCCRPNLVCSRTHKWCKYVF-{Amide} | 726 |
| [Ala5;Nle6;Glu28]GpTx-1(1-34) | {H}-DCLGA[Nle]RKCIPDNDKCCRPNLVCSRTHEWCKYVF-{Amide} | 727 |
| [Ala5;Leu6;Glu28]GpTx-1(1-34) | {H}-DCLGALRKCIPDNDKCCRPNLVCSRTHEWCKYVF-{Amide} | 728 |
| [Ala5;Phe6;Glu28]GpTx-1(1-34) | {H}-DCLGAFRKCIPDNDKCCRPNLVCSRTHEWCKYVF-{Amide} | 729 |
| [Ala5,25;Nle6]GpTx-1(1-34) | {H}-DCLGA[Nle]RKCIPDNDKCCRPNLVCSATHKWCKYVF-{Amide} | 730 |
| [Ala5,25;Leu6]GpTx-1(1-34) | {H}-DCLGALRKCIPDNDKCCRPNLVCSATHKWCKYVF-{Amide} | 731 |
| [Ala5,25;Phe6]GpTx-1(1-34) | {H}-DCLGAFRKCIPDNDKCCRPNLVCSATHKWCKYVF-{Amide} | 732 |
| [Ala5;Nle6;Glu25]GpTx-1(1-34) | {H}-DCLGA[Nle]RKCIPDNDKCCRPNLVCSETHKWCKYVF-{Amide} | 733 |
| [Ala5;Leu6;Glu25]GpTx-1(1-34) | {H}-DCLGALRKCIPDNDKCCRPNLVCSETHKWCKYVF-{Amide} | 734 |
| [Ala5;Phe6;Glu25]GpTx-1(1-34) | {H}-DCLGAFRKCIPDNDKCCRPNLVCSETHKWCKYVF-{Amide} | 735 |
| [Phe6,Pra15]GpTx-1(1-34) | {H}-DCLGFFRKCIPDND[Pra]CCRPNLVCSRTHKWCKYVF-{Amide} | 736 |
| [Ala5;His28]GpTx-1(1-34) | {H}-DCLGAMRKCIPDNDKCCRPNLVCSRTHHWCKYVF-{Amide} | 737 |
| [Ala5;Ser28]GpTx-1(1-34) | {H}-DCLGAMRKCIPDNDKCCRPNLVCSRTHSWCKYVF-{Amide} | 738 |
| [Ala5;Gln28]GpTx-1(1-34) | {H}-DCLGAMRKCIPDNDKCCRPNLVCSRTHQWCKYVF-{Amide} | 739 |
| [Ala5;3Pal28]GpTx-1(1-34) | {H}-DCLGAMRKCIPDNDKCCRPNLVCSRTH[3Pal]WCKYVF-{Amide} | 740 |
| [Ala5;4-aminoF28]GpTx-1(1-34) | {H}-DCLGAMRKCIPDNDKCCRPNLVCSRTH[4-aminoF]WCKYVF-{Amide} | 741 |
| [Ala5;K(Ac)28]GpTx-1(1-34) | {H}-DCLGAMRKCIPDNDKCCRPNLVCSRTH[K(Ac)]WCKYVF-{Amide} | 742 |
| [Ala5;SDMA28]GpTx-1(1-34) | {H}-DCLGAMRKCIPDNDKCCRPNLVCSRTH[SDMA]WCKYVF-{Amide} | 743 |
| [Ala5;hArg28]GpTx-1(1-34) | {H}-DCLGAMRKCIPDNDKCCRPNLVCSRTH[hArg]WCKYVF-{Amide} | 744 |
| [Ala5;R(Me)28]GpTx-1(1-34) | {H}-DCLGAMRKCIPDNDKCCRPNLVCSRTH[R(Me)]WCKYVF-{Amide} | 745 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Orn28]GpTx-1(1-34) | {H}-DCLGAMRKCIPDNDKCCRPNLVCSRTH[Orn]WCKYVF-{Amide} | 746 |
| [Ala5;Dap28]GpTx-1(1-34) | {H}-DCLGAMRKCIPDNDKCCRPNLVCSRTH[Dap]WCKYVF-{Amide} | 747 |
| [Ala5;Cit28]GpTx-1(1-34) | {H}-DCLGAMRKCIPDNDKCCRPNLVCSRTH[Cit]WCKYVF-{Amide} | 748 |
| [Ala5;HCit28]GpTx-1(1-34) | {H}-DCLGAMRKCIPDNDKCCRPNLVCSRTH[HCit]WCKYVF-{Amide} | 749 |
| [Asp28]GpTx-1(1-34) | {H}-DCLGFMRKCIPDNDKCCRPNLVCSRTHDWCKYVF-{Amide} | 750 |
| [Gly5;Val6]GpTx-1(1-34) | {H}-DCLGGVRKCIPDNDKCCRPNLVCSRTHKWCKYVF-{Amide} | 751 |
| [Gly5;Ile6]GpTx-1(1-34) | {H}-DCLGGIRKCIPDNDKCCRPNLVCSRTHKWCKYVF-{Amide} | 752 |
| [2-Abu5;Nle6]GpTx-1(1-34) | {H}-DCLG[2-Abu][Nle]RKCIPDNDKCCRPNLVCSRTHKWCKYVF-{Amide} | 753 |
| [Gly5;Phe6;Glu10]GpTx-1(1-34) | {H}-DCLGGFRKCEPDNDKCCRPNLVCSRTHKWCKYVF-{Amide} | 754 |
| [Gly5;Phe6;Glu28]GpTx-1(1-34) | {H}-DCLGGFRKCIPDNDKCCRPNLVCSRTHEWCKYVF-{Amide} | 755 |
| 4-Pen-[Ala5;Phe6;2-Abu13;Arg28]GpTx-1(1-34) | {4-Pen}-DCLGAFRKCIPD[2-Abu]DKCCRPNLVCSRTHRWCKYVF-{Amide} | 756 |
| 4-Pen-[Ala5;Phe6;2-Abu13]GpTx-1(1-34) | {4-Pen}-DCLGAFRKCIPD[2-Abu]DKCCRPNLVCSRTHKWCKYVF-{Amide} | 757 |
| 4-Pen-[2-Abu5,13;Leu6]GpTx-1(1-34) | {4-Pen}-DCLG[2-Abu]LRKCIPD[2-Abu]DKCCRPNLVCSRTHKWCKYVF-{Amide} | 758 |
| 4-Pen-[Nva5;Leu6;2-Abu13;Arg28]GpTx-1(1-34) | {4-Pen}-DCLG[Nva]LRKCIPD[2-Abu]DKCCRPNLVCSRTHRWCKYVF-{Amide} | 759 |
| 4-Pen-[Nva5;Leu6;2-Abu13]GpTx-1(1-34) | {4-Pen}-DCLG[Nva]LRKCIPD[2-Abu]DKCCRPNLVCSRTHKWCKYVF-{Amide} | 760 |
| [Ala5;Guf28]GpTx-1(1-34) | {H}-DCLGAMRKCIPDNDKCCRPNLVCSRTH[Guf]WCKYVF-{Amide} | 761 |
| [Ala5;Dab28]GpTx-1(1-34) | {H}-DCLGAMRKCIPDNDKCCRPNLVCSRTH[Dab]WCKYVF-{Amide} | 762 |
| [Gln28]GpTx-1(1-34) | {H}-DCLGFMRKCIPDNDKCCRPNLVCSRTHQWCKYVF-{Amide} | 763 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Phe28]GpTx-1(1-34) | {H}-DCLGAMRKCIPDNDKCCRPNLVCSRTHFWCKYVF-{Amide} | 764 |
| [Ala5;Tyr28]GpTx-1(1-34) | {H}-DCLGAMRKCIPDNDKCCRPNLVCSRTHYWCKYVF-{Amide} | 765 |
| [Ala5;Leu28]GpTx-1(1-34) | {H}-DCLGAMRKCIPDNDKCCRPNLVCSRTHLWCKYVF-{Amide} | 766 |
| [Ala5;Asn28]GpTx-1(1-34) | {H}-DCLGAMRKCIPDNDKCCRPNLVCSRTHNWCKYVF-{Amide} | 767 |
| [Ala5;Cit25]GpTx-1(1-34) | {H}-DCLGAMRKCIPDNDKCCRPNLVCS[Cit]THKWCKYVF-{Amide} | 768 |
| [Ala5;Asp28]GpTx-1(1-34) | {H}-DCLGAMRKCIPDNDKCCRPNLVCSRTHDWCKYVF-{Amide} | 769 |
| [Ala5;Met28]GpTx-1(1-34) | {H}-DCLGAMRKCIPDNDKCCRPNLVCSRTHMWCKYVF-{Amide} | 770 |
| [Ala5;K(Me)28]GpTx-1(1-34) | {H}-DCLGAMRKCIPDNDKCCRPNLVCSRTH[K(Me)]WCKYVF-{Amide} | 771 |
| [pS28]GpTx-1(1-34) | {H}-DCLGFMRKCIPDNDKCCRPNLVCSRTH[pS]NCKYVF-{Amide} | 772 |
| [Thr5;Asp10;Glu12]GpTx-1(1-34) | {H}-DCLGTMRKCDPENDKCCRPNLVCSRTHKWCKYVF-{Amide} | 773 |
| [1-Nal10;Glu33]GpTx-1(1-34) | {H}-DCLGFMRKC[1-Nal]PDNDKCCRPNLVCSRTHKWCKYEF-{Amide} | 774 |
| [1-Nal10;Glu32]GpTx-1(1-34) | {H}-DCLGFMRKC[1-Nal]PDNDKCCRPNLVCSRTHKWCKEVF-{Amide} | 775 |
| [1-Nal10;Glu31]GpTx-1(1-34) | {H}-DCLGFMRKC[1-Nal]PDNDKCCRPNLVCSRTHKWCEYVF-{Amide} | 776 |
| [1-Nal10;Ala33]GpTx-1(1-34) | {H}-DCLGFMRKC[1-Nal]PDNDKCCRPNLVCSRTHKWCKYAF-{Amide} | 777 |
| [1-Nal10;Ala32]GpTx-1(1-34) | {H}-DCLGFMRKC[1-Nal]PDNDKCCRPNLVCSRTHKWCKAVF-{Amide} | 778 |
| [1-Nal10;Ala31]GpTx-1(1-34) | {H}-DCLGFMRKC[1-Nal]PDNDKCCRPNLVCSRTHKWCAYVF-{Amide} | 779 |
| [1-Nal10;Glu28]GpTx-1(1-34) | {H}-DCLGFMRKC[1-Nal]PDNDKCCRPNLVCSRTHEWCKYVF-{Amide} | 780 |
| [1-Nal10;Glu15]GpTx-1(1-34) | {H}-DCLGFMRKC[1-Nal]PDNDECCRPNLVCSRTHKWCKYVF-{Amide} | 781 |
| [Glu8;1-Nal10]GpTx-1(1-34) | {H}-DCLGFMREC[1-Nal]PDNDKCCRPNLVCSRTHKWCKYVF-{Amide} | 782 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Glu4;1-Nal10]GpTx-1(1-34) | {H}-DCLEFMRKC[1-Nal]PDNDKCCRPNLVCSRTHKWCKYVF-{Amide} | 783 |
| [1-Nal1;Glu8]GpTx-1(1-34) | {H}-[1-Nal]CLGFMRECIPDNDKCCRPNLVCSRTHKWCKYVF-{Amide} | 784 |
| [1-Nal1;Glu7]GpTx-1(1-34) | {H}-[1-Nal]CLGFMEKCIPDNDKCCRPNLVCSRTHKWCKYVF-{Amide} | 785 |
| [1-Nal1;Glu6]GpTx-1(1-34) | {H}-[1-Nal]CLGFERKCIPDNDKCCRPNLVCSRTHKWCKYVF-{Amide} | 786 |
| [Ala5;Glu26]GpTx-1(1-34) | {H}-DCLGAMRKCIPDNDKCCRPNLVCSREHKWCKYVF-{Amide} | 787 |
| [Ala5;Glu27]GpTx-1(1-34) | {H}-DCLGAMRKCIPDNDKCCRPNLVCSRTEKWCKYVF-{Amide} | 788 |
| [Ala5;Glu31]GpTx-1(1-34) | {H}-DCLGAMRKCIPDNDKCCRPNLVCSRTHKWCEYVF-{Amide} | 789 |
| [Ala5]GpTx-1(1-34)-Glu | {H}-DCLGAMRKCIPDNDKCCRPNLVCSRTHKWCKYVFE-{Amide} | 790 |
| [Ala5,Met(O)6]GpTx-1 isomer1 | {H}-DCLGA[METO1]RKCIPDNDKCCRPNLVCSRTHKWCKYVF-{Amide} | 791 |
| [Ala5,Met(O)6]GpTx-1 isomer2 | {H}-DCLGA[METO1]RKCIPDNDKCCRPNLVCSRTHKWCKYVF-{Amide} | 792 |
| [Ala5;Phe6;Pra13]GpTx-1(1-34) | {H}-DCLGAFRKCIPD[Pra]DKCCRPNLVCSRTHKWCKYVF-{Amide} | 793 |
| [Ala5;Phe6;K(Ac-Pra)13]GpTx-1(1-34) | {H}-DCLGAFRKCIPD[K(Ac-Pra)]DKCCRPNLVCSRTHKWCKYVF-{Amide} | 794 |
| [Ala5;Phe6;K(Ac-Pra)13;Arg28]GpTx-1(1-34) | {H}-DCLGAFRKCIPD[K(Ac-Pra)]DKCCRPNLVCSRTHRWCKYVF-{Amide} | 795 |
| [Ala5;Leu6,26;Pra13;Arg28]GpTx-1(1-34) | {H}-DCLGALRKCIPD[Pra]DKCCRPNLVCSRLHRWCKYVF-{Amide} | 796 |
| [2-Abu5;Leu6;Pra13]GpTx-1(1-34) | {H}-DCLG[2-Abu]LRKCIPD[Pra]DKCCRPNLVCSRTHKWCKYVF-{Amide} | 797 |
| [Ala5;Phe6;Glu10;Pra13;Leu26;Arg28]GpTx-1(1-34) | {H}-DCLGAFRKCEPD[Pra]DKCCRPNLVCSRLHRWCKYVF-{Amide} | 798 |
| [2-Abu5;Leu6;K(Ac-Pra)13]GpTx-1(1-34) | {H}-DCLG[2-Abu]LRKCIPD[K(Ac-Pra)]DKCCRPNLVCSRTHKWCKYVF-{Amide} | 799 |
| [Ala5;Leu6,26;Glu10;Pra13;Arg28]GpTx-1(1-34) | {H}-DCLGALRKCEPD[Pra]DKCCRPNLVCSRLHRWCKYVF-{Amide} | 800 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [2-Abu5;Leu6;K(4-Pen)13;Arg28]GpTx-1(1-34) | {H}-DCLG[2-Abu]LRKCIPD[K(4-Pen)]DKCCRPNLVCSRTHRWCKYVF-{Amide} | 801 |
| [Ala5;Leu6,26;Pra12;Arg28]GpTx-1(1-34) | {H}-DCLGALRKCIP[Pra]NDKCCRPNLVCSRLHRWCKYVF-{Amide} | 802 |
| [Ala5;Phe6;Pra12;Leu26;Arg28]GpTx-1(1-34) | {H}-DCLGAFRKCIP[Pra]NDKCCRPNLVCSRLHRWCKYVF-{Amide} | 803 |
| [2-Abu5;Phe6;K(4-Pen)13]GpTx-1(1-34) | {H}-DCLG[2-Abu]FRKCIPD[K(4-Pen)]DKCCRPNLVCSRTHKWCKYVF-{Amide} | 804 |
| [Nva5;Leu6;K(4-Pen)13;Arg28]GpTx-1(1-34) | {H}-DCLG[Nva]LRKCIPD[K(4-Pen)]DKCCRPNLVCSRTHRWCKYVF-{Amide} | 805 |
| [Nva5;Leu6;K(4-Pen)13]GpTx-1(1-34) | {H}-DCLG[Nva]LRKCIPD[K(4-Pen)]DKCCRPNLVCSRTHKWCKYVF-{Amide} | 806 |
| 4-Pen-[2-Abu5,13;Leu6;Arg28]GpTx-1(1-34) | {4-Pen}-DCLG[2-Abu]LRKCIPD[2-Abu]DKCCRPNLVCSRTHRWCKYVF-{Amide} | 807 |
| [2-Abu5;Leu6;K(4-Pen)13;Glu28]GpTx-1(1-34) | {H}-DCLG[2-Abu]LRKCIPD[K(4-Pen)]DKCCRPNLVCSRTHEWCKYVF-{Amide} | 808 |
| [Ala5;Phe6;Arg28]GpTx-1(1-34) | {H}-DCLGAFRKCIPDNDKCCRPNLVCSRTHRWCKYVF-{Amide} | 809 |
| [Ala5;Leu6;Arg28]GpTx-1(1-34) | {H}-DCLGALRKCIPDNDKCCRPNLVCSRTHRWCKYVF-{Amide} | 810 |
| Gly-Ser-[Ala5;Phe6;Arg28]GpTx-1(1-34) | {H}-GSDCLGAFRKCIPDNDKCCRPNLVCSRTHRWCKYVF-{Amide} | 811 |
| Gly-Ser-[Ala5;Leu6;Arg28]GpTx-1(1-34) | {H}-GSDCLGALRKCIPDNDKCCRPNLVCSRTHRWCKYVF-{Amide} | 812 |
| [Ala5;Phe6;Arg28]GpTx-1(1-34)-Trp-FreeAcid | {H}-DCLGAFRKCIPDNDKCCRPNLVCSRTHRWCKYVFW-{FreeAcid} | 813 |
| [Ala5;Leu6;Arg28]GpTx-1(1-34)-Trp-FreeAcid | {H}-DCLGALRKCIPDNDKCCRPNLVCSRTHRWCKYVFW-{FreeAcid} | 814 |
| Gly-Ser-[Ala5;Phe6;Arg28]GpTx-1(1-34)-Trp-FreeAcid | {H}-GSDCLGAFRKCIPDNDKCCRPNLVCSRTHRWCKYVFW-{FreeAcid} | 815 |
| Gly-Ser-[Ala5;Leu6;Arg28]GpTx-1(1-34)-Trp-FreeAcid | {H}-GSDCLGALRKCIPDNDKCCRPNLVCSRTHRWCKYVFW-{FreeAcid} | 816 |
| [Ala5;Phe6;Arg28]GpTx-1(1-34)-Phe-FreeAcid | {H}-DCLGAFRKCIPDNDKCCRPNLVCSRTHRWCKYVFF-{FreeAcid} | 817 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Leu6;Arg28]GpTx-1(1-34)-Phe-FreeAcid | {H}-DCLGALRKCIPDNDKCCRPNLVCSRTHRWCKYVFF-{FreeAcid} | 818 |
| Gly-Ser-[Ala5;Phe6;Arg28]GpTx-1(1-34)-Phe-FreeAcid | {H}-GSDCLGAFRKCIPDNDKCCRPNLVCSRTHRWCKYVFF-{FreeAcid} | 819 |
| Gly-Ser-[Ala5;Leu6;Arg28]GpTx-1(1-34)-Phe-FreeAcid | {H}-GSDCLGALRKCIPDNDKCCRPNLVCSRTHRWCKYVFF-{FreeAcid} | 820 |
| Gly-Ser-[Ala5;Phe6;Arg28]GpTx-1(1-34)-FreeAcid | {H}-GSDCLGAFRKCIPDNDKCCRPNLVCSRTHRWCKYVF-{FreeAcid} | 821 |
| Gly-Ser-[Ala5;Leu6;Arg28]GpTx-1(1-34)-FreeAcid | {H}-GSDCLGALRKCIPDNDKCCRPNLVCSRTHRWCKYVF-{FreeAcid} | 822 |
| [Ala5;Phe6;Arg28]GpTx-1(1-34)-FreeAcid | {H}-DCLGAFRKCIPDNDKCCRPNLVCSRTHRWCKYVF-{FreeAcid} | 823 |
| [Ala5,28;Phe6]GpTx-1(1-34)-FreeAcid | {H}-DCLGAFRKCIPDNDKCCRPNLVCSRTHAWCKYVF-{FreeAcid} | 824 |
| [Ala5;Phe6;Asp28]GpTx-1(1-34)-FreeAcid | {H}-DCLGAFRKCIPDNDKCCRPNLVCSRTHDWCKYVF-{FreeAcid} | 825 |
| [Ala5;Phe6;Glu28]GpTx-1(1-34)-FreeAcid | {H}-DCLGAFRKCIPDNDKCCRPNLVCSRTHEWCKYVF-{FreeAcid} | 826 |
| [Ala5;Phe6;Gly28]GpTx-1(1-34)-FreeAcid | {H}-DCLGAFRKCIPDNDKCCRPNLVCSRTHGWCKYVF-{FreeAcid} | 827 |
| [Ala5;Phe6;His28]GpTx-1(1-34)-FreeAcid | {H}-DCLGAFRKCIPDNDKCCRPNLVCSRTHHWCKYVF-{FreeAcid} | 828 |
| [Ala5;Phe6]GpTx-1(1-34)-FreeAcid | {H}-DCLGAFRKCIPDNDKCCRPNLVCSRTHKWCKYVF-{FreeAcid} | 829 |
| [Ala5;Phe6;Leu28]GpTx-1(1-34)-FreeAcid | {H}-DCLGAFRKCIPDNDKCCRPNLVCSRTHLWCKYVF-{FreeAcid} | 830 |
| [Ala5;Phe6;Met28]GpTx-1(1-34)-FreeAcid | {H}-DCLGAFRKCIPDNDKCCRPNLVCSRTHMWCKYVF-{FreeAcid} | 831 |
| [Ala5;Phe6;Asn28]GpTx-1(1-34)-FreeAcid | {H}-DCLGAFRKCIPDNDKCCRPNLVCSRTHNWCKYVF-{FreeAcid} | 832 |
| [Ala5;Phe6;Pro28]GpTx-1(1-34)-FreeAcid | {H}-DCLGAFRKCIPDNDKCCRPNLVCSRTHPWCKYVF-{FreeAcid} | 833 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Phe6;Gln28]GpTx-1(1-34)-FreeAcid | {H}-DCLGAFRKCIPDNDKCCRPNLVCSRTHQWCKYVF-{FreeAcid} | 834 |
| [Ala5;Phe6;Ser28]GpTx-1(1-34)-FreeAcid | {H}-DCLGAFRKCIPDNDKCCRPNLVCSRTHSWCKYVF-{FreeAcid} | 835 |
| [Ala5,13;Phe6;Arg28]GpTx-1(1-34)-FreeAcid | {H}-DCLGAFRKCIPDADKCCRPNLVCSRTHRWCKYVF-{FreeAcid} | 836 |
| [Ala5;Phe6;Asp13;Arg28]GpTx-1(1-34)-FreeAcid | {H}-DCLGAFRKCIPDDDKCCRPNLVCSRTHRWCKYVF-{FreeAcid} | 837 |
| [Ala5;Phe6;Glu13;Arg28]GpTx-1(1-34)-FreeAcid | {H}-DCLGAFRKCIPDEDKCCRPNLVCSRTHRWCKYVF-{FreeAcid} | 838 |
| [Ala5;Phe6,13;Arg28]GpTx-1(1-34)-FreeAcid | {H}-DCLGAFRKCIPDFDKCCRPNLVCSRTHRWCKYVF-{FreeAcid} | 839 |
| [Ala5;Phe6;Gly13;Arg28]GpTx-1(1-34)-FreeAcid | {H}-DCLGAFRKCIPDGDKCCRPNLVCSRTHRWCKYVF-{FreeAcid} | 840 |
| [Ala5;Phe6;His13;Arg28]GpTx-1(1-34)-FreeAcid | {H}-DCLGAFRKCIPDHDKCCRPNLVCSRTHRWCKYVF-{FreeAcid} | 841 |
| [Ala5;Phe6;Ile13;Arg28]GpTx-1(1-34)-FreeAcid | {H}-DCLGAFRKCIPDIDKCCRPNLVCSRTHRWCKYVF-{FreeAcid} | 842 |
| [Ala5;Phe6;Lys13;Arg28]GpTx-1(1-34)-FreeAcid | {H}-DCLGAFRKCIPDKDKCCRPNLVCSRTHRWCKYVF-{FreeAcid} | 843 |
| [Ala5;Phe6;Leu13;Arg28]GpTx-1(1-34)-FreeAcid | {H}-DCLGAFRKCIPDLDKCCRPNLVCSRTHRWCKYVF-{FreeAcid} | 844 |
| [Ala5;Phe6;Met13;Arg28]GpTx-1(1-34)-FreeAcid | {H}-DCLGAFRKCIPDMDKCCRPNLVCSRTHRWCKYVF-{FreeAcid} | 845 |
| [Ala5;Phe6;Pro13;Arg28]GpTx-1(1-34)-FreeAcid | {H}-DCLGAFRKCIPDPDKCCRPNLVCSRTHRWCKYVF-{FreeAcid} | 846 |
| [Ala5;Phe6;Gln13;Arg28]GpTx-1(1-34)-FreeAcid | {H}-DCLGAFRKCIPDQDKCCRPNLVCSRTHRWCKYVF-{FreeAcid} | 847 |
| [Ala5;Phe6;Arg13,28]GpTx-1(1-34)-FreeAcid | {H}-DCLGAFRKCIPDRDKCCRPNLVCSRTHRWCKYVF-{FreeAcid} | 848 |
| [Ala5;Phe6;Ser13;Arg28]GpTx-1(1-34)-FreeAcid | {H}-DCLGAFRKCIPDSDKCCRPNLVCSRTHRWCKYVF-{FreeAcid} | 849 |
| [Ala5;Phe6;Thr13;Arg28]GpTx-1(1-34)-FreeAcid | {H}-DCLGAFRKCIPDTDKCCRPNLVCSRTHRWCKYVF-{FreeAcid} | 850 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Phe6;Val13; Arg28]GpTx-1(1-34)-FreeAcid | {H}-DCLGAFRKCIPDVDKCCRPNLVCSRTHRWCKYVF-{FreeAcid} | 851 |
| [Ala5;Phe6;Trp13; Arg28]GpTx-1(1-34)-FreeAcid | {H}-DCLGAFRKCIPDWDKCCRPNLVCSRTHRWCKYVF-{FreeAcid} | 852 |
| [Ala5;Leu6;Arg28]GpTx-1(1-34)-FreeAcid | {H}-DCLGALRKCIPDNDKCCRPNLVCSRTHRWCKYVF-{FreeAcid} | 853 |
| [Ala5;Leu6;Asp28]GpTx-1(1-34)-FreeAcid | {H}-DCLGALRKCIPDNDKCCRPNLVCSRTHDWCKYVF-{FreeAcid} | 854 |
| [Ala5;Leu6;Glu28]GpTx-1(1-34)-FreeAcid | {H}-DCLGALRKCIPDNDKCCRPNLVCSRTHEWCKYVF-{FreeAcid} | 855 |
| [Ala5;Leu6,28]GpTx-1(1-34)-FreeAcid | {H}-DCLGALRKCIPDNDKCCRPNLVCSRTHLWCKYVF-{FreeAcid} | 856 |
| [Ala5;Leu6;Met28]GpTx-1(1-34)-FreeAcid | {H}-DCLGALRKCIPDNDKCCRPNLVCSRTHMWCKYVF-{FreeAcid} | 857 |
| [Ala5;Leu6;Gln28]GpTx-1(1-34)-FreeAcid | {H}-DCLGALRKCIPDNDKCCRPNLVCSRTHQWCKYVF-{FreeAcid} | 858 |
| [Ala5;Leu6;Ser28]GpTx-1(1-34)-FreeAcid | {H}-DCLGALRKCIPDNDKCCRPNLVCSRTHSWCKYVF-{FreeAcid} | 859 |
| [Ala5,13;Leu6;Arg28]GpTx-1(1-34)-FreeAcid | {H}-DCLGALRKCIPDADKCCRPNLVCSRTHRWCKYVF-{FreeAcid} | 860 |
| [Ala5;Leu6;Asp13; Arg28]GpTx-1(1-34)-FreeAcid | {H}-DCLGALRKCIPDDDKCCRPNLVCSRTHRWCKYVF-{FreeAcid} | 861 |
| [Ala5;Leu6;Glu13; Arg28]GpTx-1(1-34)-FreeAcid | {H}-DCLGALRKCIPDEDKCCRPNLVCSRTHRWCKYVF-{FreeAcid} | 862 |
| [Ala5;Leu6;Phe13; Arg28]GpTx-1(1-34)-FreeAcid | {H}-DCLGALRKCIPDFDKCCRPNLVCSRTHRWCKYVF-{FreeAcid} | 863 |
| [Ala5;Leu6;His13; Arg28]GpTx-1(1-34)-FreeAcid | {H}-DCLGALRKCIPDHDKCCRPNLVCSRTHRWCKYVF-{FreeAcid} | 864 |
| [Ala5;Leu6;Ile13;Arg28]GpTx-1(1-34)-FreeAcid | {H}-DCLGALRKCIPDIDKCCRPNLVCSRTHRWCKYVF-{FreeAcid} | 865 |
| [Ala5;Leu6;Lys13; Arg28]GpTx-1(1-34)-FreeAcid | {H}-DCLGALRKCIPDKDKCCRPNLVCSRTHRWCKYVF-{FreeAcid} | 866 |
| [Ala5;Leu6,13;Arg28]GpTx-1(1-34)-FreeAcid | {H}-DCLGALRKCIPDLDKCCRPNLVCSRTHRWCKYVF-{FreeAcid} | 867 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5;Leu6;Met13; Arg28]GpTx-1(1-34)-FreeAcid | {H}-DCLGALRKCIPDMDKCCRPNLVCSRTHRWCKYVF-{FreeAcid} | 868 |
| [Ala5;Leu6;Gln13; Arg28]GpTx-1(1-34)-FreeAcid | {H}-DCLGALRKCIPDQDKCCRPNLVCSRTHRWCKYVF-{FreeAcid} | 869 |
| [Ala5;Leu6;Arg13, 28]GpTx-1(1-34)-FreeAcid | {H}-DCLGALRKCIPDRDKCCRPNLVCSRTHRWCKYVF-{FreeAcid} | 870 |
| [Ala5;Leu6;Ser13; Arg28]GpTx-1(1-34)-FreeAcid | {H}-DCLGALRKCIPDSDKCCRPNLVCSRTHRWCKYVF-{FreeAcid} | 871 |
| [Ala5;Leu6;Val13; Arg28]GpTx-1(1-34)-FreeAcid | {H}-DCLGALRKCIPDVDKCCRPNLVCSRTHRWCKYVF-{FreeAcid} | 872 |
| [Ala5;Leu6;Tyr13; Arg28]GpTx-1(1-34)-FreeAcid | {H}-DCLGALRKCIPDYDKCCRPNLVCSRTHRWCKYVF-{FreeAcid} | 873 |
| Gly-Ser-[Ala5;Leu6;Arg28]GpTx-1(1-34)-Gly-Free Acid | {H}-GSDCLGALRKCIPDNDKCCRPNLVCSRTHRWCKYVFG-{FreeAcid} | 874 |
| Gly-Ser-[Ala5;Leu6;Arg28]GpTx-1(1-34)-Phe-Gly-Free Acid | {H}-GSDCLGALRKCIPDNDKCCRPNLVCSRTHRWCKYVFFG-{FreeAcid} | 875 |
| Gly-Ser-[Ala5,13;Leu6;Arg28]GpTx-1(1-34)-Phe-Gly-Free Acid | {H}-GSDCLGALRKCIPDADKCCRPNLVCSRTHRWCKYVFFG-{FreeAcid} | 876 |
| Gly-Ser-[Ala5;Leu6;Arg28]GpTx-1(1-34)-Ile-Free Acid | {H}-GSDCLGALRKCIPDNDKCCRPNLVCSRTHRWCKYVFI-{FreeAcid} | 877 |
| Gly-Ser-[Ala5;Leu6;Arg28]GpTx-1(1-34)-Phe-Ile-Free Acid | {H}-GSDCLGALRKCIPDNDKCCRPNLVCSRTHRWCKYVFFI-{FreeAcid} | 878 |
| Gly-Ser-[Ala5,13;Leu6;Arg28]GpTx-1(1-34)-Ile-Free Acid | {H}-GSDCLGALRKCIPDADKCCRPNLVCSRTHRWCKYVFI-{FreeAcid} | 879 |
| Gly-Ser-[Ala5,13;Leu6;Arg28]GpTx-1(1-34)-Phe-Ile-Free Acid | {H}-GSDCLGALRKCIPDADKCCRPNLVCSRTHRWCKYVFFI-{FreeAcid} | 880 |
| Gly-Ser-[Ala5;Leu6;Arg28]GpTx-1(1-34)-Leu-Free Acid | {H}-GSDCLGALRKCIPDNDKCCRPNLVCSRTHRWCKYVFL-{FreeAcid} | 881 |
| Gly-Ser-[Ala5;Leu6;Arg28]GpTx-1(1-34)-Phe-Leu-Free Acid | {H}-GSDCLGALRKCIPDNDKCCRPNLVCSRTHRWCKYVFFL-{FreeAcid} | 882 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ser-[Ala5,13;Leu6;Arg28]GpTx-1(1-34)-Leu-Free Acid | {H}-GSDCLGALRKCIPDADKCCRPNLVCSRTHRWCKYVFL-{FreeAcid} | 883 |
| Gly-Ser-[Ala5,13;Leu6;Arg28]GpTx-1(1-34)-Phe-Leu-Free Acid | {H}-GSDCLGALRKCIPDADKCCRPNLVCSRTHRWCKYVFFL-{FreeAcid} | 884 |
| Gly-Ser-[Ala5;Leu6;Arg28]GpTx-1(1-34)-Ser-Free Acid | {H}-GSDCLGALRKCIPDNDKCCRPNLVCSRTHRWCKYVFS-{FreeAcid} | 885 |
| Gly-Ser-[Ala5;Leu6;Arg28]GpTx-1(1-34)-Phe-Ser-Free Acid | {H}-GSDCLGALRKCIPDNDKCCRPNLVCSRTHRWCKYVFFS-{FreeAcid} | 886 |
| Gly-Ser-[Ala5,13;Leu6;Arg28]GpTx-1(1-34)-Ser-Free Acid | {H}-GSDCLGALRKCIPDADKCCRPNLVCSRTHRWCKYVFS-{FreeAcid} | 887 |
| Gly-Ser-[Ala5,13;Leu6;Arg28]GpTx-1(1-34)-Phe-Ser-Free Acid | {H}-GSDCLGALRKCIPDADKCCRPNLVCSRTHRWCKYVFFS-{FreeAcid} | 888 |
| Gly-Ser-[Ala5;Leu6;Arg28]GpTx-1(1-34)-Thr-Free Acid | {H}-GSDCLGALRKCIPDNDKCCRPNLVCSRTHRWCKYVFT-{FreeAcid} | 889 |
| Gly-Ser-[Ala5;Leu6;Arg28]GpTx-1(1-34)-Phe-Thr-Free Acid | {H}-GSDCLGALRKCIPDNDKCCRPNLVCSRTHRWCKYVFFT-{FreeAcid} | 890 |
| Gly-Ser-[Ala5,13;Leu6;Arg28]GpTx-1(1-34)-Thr-Free Acid | {H}-GSDCLGALRKCIPDADKCCRPNLVCSRTHRWCKYVFT-{FreeAcid} | 891 |
| Gly-Ser-[Ala5,13;Leu6;Arg28]GpTx-1(1-34)-Phe-Thr-Free Acid | {H}-GSDCLGALRKCIPDADKCCRPNLVCSRTHRWCKYVFFT-{FreeAcid} | 892 |
| Gly-Ser-[Ala5;Leu6;Arg28]GpTx-1(1-34)-Tyr-Free Acid | {H}-GSDCLGALRKCIPDNDKCCRPNLVCSRTHRWCKYVFY-{FreeAcid} | 893 |
| Gly-Ser-[Ala5;Leu6;Arg28]GpTx-1(1-34)-Phe-Tyr-Free Acid | {H}-GSDCLGALRKCIPDNDKCCRPNLVCSRTHRWCKYVFFY-{FreeAcid} | 894 |
| Gly-Ser-[Ala5,13;Leu6;Arg28]GpTx-1(1-34)-Tyr-Free Acid | {H}-GSDCLGALRKCIPDADKCCRPNLVCSRTHRWCKYVFY-{FreeAcid} | 895 |
| Gly-Ser-[Ala5,13;Leu6;Arg28]GpTx-1(1-34)-Phe-Tyr-Free Acid | {H}-GSDCLGALRKCIPDADKCCRPNLVCSRTHRWCKYVFFY-{FreeAcid} | 896 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ser-[Ala5;Leu6;Arg28]GpTx-1(1-34)-Ala-Free Acid | {H}-GSDCLGALRKCIPDNDKCCRPNLVCSRTHRWCKYVFA-{FreeAcid} | 897 |
| Gly-Ser-[Ala5;Leu6;Arg28]GpTx-1(1-34)-Phe-Ala-Free Acid | {H}-GSDCLGALRKCIPDNDKCCRPNLVCSRTHRWCKYVFFA-{FreeAcid} | 898 |
| Gly-Ser-[Ala5;Leu6;Arg28]GpTx-1(1-34)-Phe-Phe-Ala-Free Acid | {H}-GSDCLGALRKCIPDNDKCCRPNLVCSRTHRWCKYVFFFA-{FreeAcid} | 899 |
| Gly-Ser-[Ala5;Leu6;Arg28]GpTx-1(1-34)-Phe-Tyr-Ala-Free Acid | {H}-GSDCLGALRKCIPDNDKCCRPNLVCSRTHRWCKYVFFYA-{FreeAcid} | 900 |
| Gly-Ser-[Ala5;Leu6;Arg28]GpTx-1(1-34)-Phe-Leu-Ala-Free Acid | {H}-GSDCLGALRKCIPDNDKCCRPNLVCSRTHRWCKYVFFLA-{FreeAcid} | 901 |
| Gly-Ser-[Ala5;Leu6;Arg28]GpTx-1(1-34)-Phe-Ile-Ala-Free Acid | {H}-GSDCLGALRKCIPDNDKCCRPNLVCSRTHRWCKYVFFIA-{FreeAcid} | 902 |
| Gly-Ser-[Ala5;Leu6;Arg28]GpTx-1(1-34)-Phe-Ala-Ala-Free Acid | {H}-GSDCLGALRKCIPDNDKCCRPNLVCSRTHRWCKYVFFAA-{FreeAcid} | 903 |
| Gly-Ser-[Ala5;Leu6;Arg28]GpTx-1(1-34)-Phe-Ser-Ala-Free Acid | {H}-GSDCLGALRKCIPDNDKCCRPNLVCSRTHRWCKYVFFSA-{FreeAcid} | 904 |
| Gly-Ser-[Ala5;Leu6;Arg28]GpTx-1(1-34)-Phe-Thr-Ala-Free Acid | {H}-GSDCLGALRKCIPDNDKCCRPNLVCSRTHRWCKYVFFTA-{FreeAcid} | 905 |
| Gly-Ser-[Ala5;Leu6;Arg28]GpTx-1(1-34)-Phe-Ala-Ala-Free Acid | {H}-GSDCLGALRKCIPDNDKCCRPNLVCSRTHRWCKYVFFAA-{FreeAcid} | 906 |
| Gly-Ser-[Ala5;Leu6;Arg28]GpTx-1(1-34)-Phe-Gly-Ala-Free Acid | {H}-GSDCLGALRKCIPDNDKCCRPNLVCSRTHRWCKYVFFGA-{FreeAcid} | 907 |
| Gly-Ser-[Ala5,13;Leu6;Arg28]GpTx-1(1-34)-Ala-Free Acid | {H}-GSDCLGALRKCIPDADKCCRPNLVCSRTHRWCKYVFA-{FreeAcid} | 908 |
| Gly-Ser-[Ala5,13;Leu6;Arg28]GpTx-1(1-34)-Phe-Ala-Free Acid | {H}-GSDCLGALRKCIPDADKCCRPNLVCSRTHRWCKYVFFA-{FreeAcid} | 909 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ser-[Ala5,13;Leu6;Arg28]GpTx-1(1-34)-Phe-Phe-Ala-Free Acid | {H}-GSDCLGALRKCIPDADKCCRPNLVCSRTHRWCKYVFFFA-{FreeAcid} | 910 |
| Gly-Ser-[Ala5,13;Leu6;Arg28]GpTx-1(1-34)-Phe-Tyr-Ala-Free Acid | {H}-GSDCLGALRKCIPDADKCCRPNLVCSRTHRWCKYVFFYA-{FreeAcid} | 911 |
| Gly-Ser-[Ala5,13;Leu6;Arg28]GpTx-1(1-34)-Phe-Leu-Ala-Free Acid | {H}-GSDCLGALRKCIPDADKCCRPNLVCSRTHRWCKYVFFLA-{FreeAcid} | 912 |
| Gly-Ser-[Ala5,13;Leu6;Arg28]GpTx-1(1-34)-Phe-Ile-Ala-Free Acid | {H}-GSDCLGALRKCIPDADKCCRPNLVCSRTHRWCKYVFFIA-{FreeAcid} | 913 |
| Gly-Ser-[Ala5,13;Leu6;Arg28]GpTx-1(1-34)-Phe-Ala-Ala-Free Acid | {H}-GSDCLGALRKCIPDADKCCRPNLVCSRTHRWCKYVFFAA-{FreeAcid} | 914 |
| Gly-Ser-[Ala5,13;Leu6;Arg28]GpTx-1(1-34)-Phe-Ser-Ala-Free Acid | {H}-GSDCLGALRKCIPDADKCCRPNLVCSRTHRWCKYVFFSA-{FreeAcid} | 915 |
| Gly-Ser-[Ala5,13;Leu6;Arg28]GpTx-1(1-34)-Phe-Thr-Ala-Free Acid | {H}-GSDCLGALRKCIPDADKCCRPNLVCSRTHRWCKYVFFTA-{FreeAcid} | 916 |
| Gly-Ser-[Ala5,13;Leu6;Arg28]GpTx-1(1-34)-Phe-Ala-Ala-Free Acid | {H}-GSDCLGALRKCIPDADKCCRPNLVCSRTHRWCKYVFFAA-{FreeAcid} | 917 |
| Gly-Ser-[Ala5,13;Leu6;Arg28]GpTx-1(1-34)-Phe-Gly-Ala-Free Acid | {H}-GSDCLGALRKCIPDADKCCRPNLVCSRTHRWCKYVFFGA-{FreeAcid} | 918 |
| Gly-Ser-[Ala5;Leu6;Arg28]GpTx-1(1-34)-Ala-Free Acid | {H}-GSDCLGALRKCIPDNDKCCRPNLVCSRTHRWCKYVFA-{FreeAcid} | 919 |
| Gly-Ser-[Ala5;Leu6;Arg28]GpTx-1(1-34)-Phe-Ala-Free Acid | {H}-GSDCLGALRKCIPDNDKCCRPNLVCSRTHRWCKYVFFA-{FreeAcid} | 920 |
| Gly-Ser-[Ala5,13;Leu6;Arg28]GpTx-1(1-34)-Ala-Free Acid | {H}-GSDCLGALRKCIPDADKCCRPNLVCSRTHRWCKYVFA-{FreeAcid} | 921 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ser-[Ala5,13;Leu6;Arg28]GpTx-1(1-34)-Phe-Ala-Free Acid | {H}-GSDCLGALRKCIPDADKCCRPNLVCSRTHRWCKYVFFA-{FreeAcid} | 922 |
| Gly-Ser-[Ala5;Leu6;Arg28]GpTx-1(1-34)-Phe-Phe-Free Acid | {H}-GSDCLGALRKCIPDNDKCCRPNLVCSRTHRWCKYVFFF-{FreeAcid} | 923 |
| Gly-Gly-Ser-[Ala5;Leu6;Arg28]GpTx-1(1-34)-Phe-Free Acid | {H}-GGSDCLGALRKCIPDNDKCCRPNLVCSRTHRWCKYVFF-{FreeAcid} | 924 |
| Gly-Gly-Gly-Ser-[Ala5;Leu6;Arg28]GpTx-1(1-34)-Phe-Free Acid | {H}-GGGSDCLGALRKCIPDNDKCCRPNLVCSRTHRWCKYVFF-{FreeAcid} | 925 |
| Gly-Gly-Gly-Gly-Ser-[Ala5;Leu6;Arg28]GpTx-1(1-34)-Phe-Free Acid | {H}-GGGGSDCLGALRKCIPDNDKCCRPNLVCSRTHRWCKYVFF-{FreeAcid} | 926 |
| Ser-Gly-Gly-Gly-Gly-Ser-[Ala5;Leu6;Arg28]GpTx-1(1-34)-Phe-Free Acid | {H}-SGGGGSDCLGALRKCIPDNDKCCRPNLVCSRTHRWCKYVFF-{FreeAcid} | 927 |
| Gly-Ser-Gly-Gly-Gly-Gly-Ser-[Ala5;Leu6;Arg28]GpTx-1(1-34)-Phe-Free Acid | {H}-GSGGGGSDCLGALRKCIPDNDKCCRPNLVCSRTHRWCKYVFF-{FreeAcid} | 928 |
| Gly-Gly-Ser-Gly-Gly-Gly-Gly-Ser-[Ala5;Leu6;Arg28]GpTx-1(1-34)-Phe-Free Acid | {H}-GGSGGGGSDCLGALRKCIPDNDKCCRPNLVCSRTHRWCKYVFF-{FreeAcid} | 929 |
| Gly-Gly-Gly-Ser-Gly-Gly-Gly-Gly-Ser-[Ala5;Leu6;Arg28]GpTx-1(1-34)-Phe-Free Acid | {H}-GGGSGGGGSDCLGALRKCIPDNDKCCRPNLVCSRTHRWCKYVFF-{FreeAcid} | 930 |
| Gly-Gly-Gly-Gly-Ser-Gly-Gly-Gly-Gly-Ser-[Ala5;Leu6;Arg28]GpTx-1(1-34)-Phe-Free Acid | {H}-GGGGSGGGGSDCLGALRKCIPDNDKCCRPNLVCSRTHRWCKYVFF-{FreeAcid} | 931 |
| Gly-Gly-Gly-Gly-Ser-Gly-Gly-Gly-Gly-Ser-[Ala5;Phe6;Arg28]GpTx-1(1-34)-Phe-Free Acid | {H}-GGGGSGGGGSDCLGAFRKCIPDNDKCCRPNLVCSRTHRWCKYVFF-{FreeAcid} | 932 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Gly-Gly-Gly-Ser-Gly-Gly-Gly-Gly-Ser-[Ala5,13;Phe6;Arg28]GpTx-1(1-34)-Phe-Free Acid | {H}-GGGGSGGGGSDCLGAFRKCIPDADKCCRPNLVCSRTHRWCKYVFF-{FreeAcid} | 933 |
| Gly-Ser-[Ala5,13;Leu6;Arg28]GpTx-1(1-34)-Phe-Free Acid | {H}-GSDSDCLGALRKCIPDADKCCRPNLVCSRTHRWCKYVFF-{FreeAcid} | 934 |
| Gly-Ser-[Ala5,13;Leu6;Arg28]GpTx-1(1-34)-Gly-Phe-Free Acid | {H}-GSDSDCLGALRKCIPDADKCCRPNLVCSRTHRWCKYVFGF-{FreeAcid} | 935 |
| Gly-Ser-[Ala5,13;Leu6;Arg28]GpTx-1(1-34)-Phe-Free Acid | {H}-GSDSDCLGALRKCIPDADKCCRPNLVCSRTHRWCKYVFF-{FreeAcid} | 936 |
| Gly-Ser-[Ala5,13;Leu6;Arg28]GpTx-1(1-34)-Phe-Free Acid | {H}-GSDSDCLGALRKCIPDADKCCRPNLVCSRTHRWCKYVFF-{FreeAcid} | 937 |
| Gly-Gly-Ser-[Ala5,13;Leu6;Arg28]GpTx-1(1-34)-Phe-Free Acid | {H}-GGSDCLGALRKCIPDADKCCRPNLVCSRTHRWCKYVFF-{FreeAcid} | 938 |
| Gly-Gly-Gly-Ser-[Ala5,13;Leu6;Arg28]GpTx-1(1-34)-Phe-Free Acid | {H}-GGGSDCLGALRKCIPDADKCCRPNLVCSRTHRWCKYVFF-{FreeAcid} | 939 |
| Gly-Gly-Gly-Gly-Ser-[Ala5,13;Leu6;Arg28]GpTx-1(1-34)-Phe-Free Acid | {H}-GGGGSDCLGALRKCIPDADKCCRPNLVCSRTHRWCKYVFF-{FreeAcid} | 940 |
| Ser-Gly-Gly-Gly-Gly-Ser-[Ala5,13;Leu6;Arg28]GpTx-1(1-34)-Phe-Free Acid | {H}-SGGGGSDCLGALRKCIPDADKCCRPNLVCSRTHRWCKYVFF-{FreeAcid} | 941 |
| Gly-Ser-Gly-Gly-Gly-Gly-Ser-[Ala5,13;Leu6;Arg28]GpTx-1(1-34)-Phe-Free Acid | {H}-GSGGGGSDCLGALRKCIPDADKCCRPNLVCSRTHRWCKYVFF-{FreeAcid} | 942 |
| Gly-Gly-Ser-Gly-Gly-Gly-Gly-Ser-[Ala5,13;Leu6;Arg28]GpTx-1(1-34)-Phe-Free Acid | {H}-GGSGGGGSDCLGALRKCIPDADKCCRPNLVCSRTHRWCKYVFF-{FreeAcid} | 943 |
| Gly-Gly-Gly-Ser-Gly-Gly-Gly-Gly-Ser-[Ala5,13;Leu6;Arg28]GpTx-1(1-34)-Phe-Free Acid | {H}-GGGSGGGGSDCLGALRKCIPDADKCCRPNLVCSRTHRWCKYVFF-{FreeAcid} | 944 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Gly-Gly-Gly-Ser-Gly-Gly-Gly-Gly-Ser-[Ala5,13;Leu6;Arg28]GpTx-1(1-34)-Phe-Free Acid | {H}-GGGGSGGGGSDCLGALRKCIPDADKCCRPNLVCSRTHRWCKYVFF-{FreeAcid} | 945 |
| Gly-Ser-[Ala5;Leu6;Gly13;Arg28]GpTx-1(1-34)-Phe-Free Acid | {H}-GSDSDCLGALRKCIPDGDKCCRPNLVCSRTHRWCKYVFF-{FreeAcid} | 946 |
| Gly-Ser-[Ala5;Leu6;Ser13;Arg28]GpTx-1(1-34)-Phe-Free Acid | {H}-GSDCLGALRKCIPDSDKCCRPNLVCSRTHRWCKYVFF-{FreeAcid} | 947 |
| Gly-Ser-[Ala5;Leu6;Ile13;Arg28]GpTx-1(1-34)-Phe-Free Acid | {H}-GSDCLGALRKCIPDIDKCCRPNLVCSRTHRWCKYVFF-{FreeAcid} | 948 |
| Gly-Ser-[Ala5;Leu6;Pro13;Arg28]GpTx-1(1-34)-Phe-Free Acid | {H}-GSDSDCLGALRKCIPDPDKCCRPNLVCSRTHRWCKYVFF-{FreeAcid} | 949 |
| Gly-Ser-[Ala5;Leu6;Met13;Arg28]GpTx-1(1-34)-Phe-Free Acid | {H}-GSDSDCLGALRKCIPDMDKCCRPNLVCSRTHRWCKYVFF-{FreeAcid} | 950 |
| Gly-Ser-[Ala5;Leu6;Val13;Arg28]GpTx-1(1-34)-Phe-Free Acid | {H}-GSDSDCLGALRKCIPDVDKCCRPNLVCSRTHRWCKYVFF-{FreeAcid} | 951 |
| Gly-Ser-[Ala5;Leu6;Thr13;Arg28]GpTx-1(1-34)-Phe-Free Acid | {H}-GSDSDCLGALRKCIPDTDKCCRPNLVCSRTHRWCKYVFF-{FreeAcid} | 952 |
| Gly-Ser-[Ala5;Leu6;Phe13;Arg28]GpTx-1(1-34)-Phe-Free Acid | {H}-GSDSDCLGALRKCIPDFDKCCRPNLVCSRTHRWCKYVFF-{FreeAcid} | 953 |
| Gly-Ser-[Ala5;Leu6;Tyr13;Arg28]GpTx-1(1-34)-Phe-Free Acid | {H}-GSDSDCLGALRKCIPDYDKCCRPNLVCSRTHRWCKYVFF-{FreeAcid} | 954 |
| Gly-Ser-[Ala5;Phe6;Gly13;Arg28]GpTx-1(1-34)-Phe-Free Acid | {H}-GSDSDCLGAFRKCIPDGDKCCRPNLVCSRTHRWCKYVFF-{FreeAcid} | 955 |
| Gly-Ser-[Ala5;Phe6;Ser13;Arg28]GpTx-1(1-34)-Phe-Free Acid | {H}-GSDSDCLGAFRKCIPDSDKCCRPNLVCSRTHRWCKYVFF-{FreeAcid} | 956 |
| Gly-Ser-[Ala5;Phe6;Ile13;Arg28]GpTx-1(1-34)-Phe-Free Acid | {H}-GSDCLGAFRKCIPDIDKCCRPNLVCSRTHRWCKYVFF-{FreeAcid} | 957 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ser-[Ala5;Phe6;Leu13;Arg28]GpTx-1(1-34)-Phe-Free Acid | {H}-GSDCLGAFRKCIPDLDKCCRPNLVCSRTHRWCKYVFF-{FreeAcid} | 958 |
| Gly-Ser-[Ala5;Phe6;Met13;Arg28]GpTx-1(1-34)-Phe-Free Acid | {H}-GSDSDCLGAFRKCIPDMDKCCRPNLVCSRTHRWCKYVFF-{FreeAcid} | 959 |
| Gly-Ser-[Ala5;Phe6;Val13;Arg28]GpTx-1(1-34)-Phe-Free Acid | {H}-GSDSDCLGAFRKCIPDVDKCCRPNLVCSRTHRWCKYVFF-{FreeAcid} | 960 |
| Gly-Ser-[Ala5;Phe6;Thr13;Arg28]GpTx-1(1-34)-Phe-Free Acid | {H}-GSDSDCLGAFRKCIPDTDKCCRPNLVCSRTHRWCKYVFF-{FreeAcid} | 961 |
| Gly-Ser-[Ala5;Phe6,13;Arg28]GpTx-1(1-34)-Phe-Free Acid | {H}-GSDSDCLGAFRKCIPDFDKCCRPNLVCSRTHRWCKYVFF-{FreeAcid} | 962 |
| Gly-Ser-[Ala5;Phe6;Tyr13;Arg28]GpTx-1(1-34)-Phe-Free Acid | {H}-GSDSDCLGAFRKCIPDYDKCCRPNLVCSRTHRWCKYVFF-{FreeAcid} | 963 |
| Gly-Ile-[Ala5;Leu6;Arg28]GpTx-1(1-34)-Phe-Free Acid | {H}-GIDCLGALRKCIPDNDKCCRPNLVCSRTHRWCKYVFF-{FreeAcid} | 964 |
| Gly-Ala-[Ala5;Leu6;Arg28]GpTx-1(1-34)-Phe-Free Acid | {H}-GADCLGALRKCIPDNDKCCRPNLVCSRTHRWCKYVFF-{FreeAcid} | 965 |
| Gly-Thr-[Ala5;Leu6;Arg28]GpTx-1(1-34)-Phe-Free Acid | {H}-GTDCLGALRKCIPDNDKCCRPNLVCSRTHRWCKYVFF-{FreeAcid} | 966 |
| Gly-Ala-[Ala5;Leu6;Arg28]GpTx-1(1-34)-Phe-Free Acid | {H}-GADCLGALRKCIPDNDKCCRPNLVCSRTHRWCKYVFF-{FreeAcid} | 967 |
| Gly-Gly-[Ala5;Leu6;Arg28]GpTx-1(1-34)-Phe-Free Acid | {H}-GGDCLGALRKCIPDNDKCCRPNLVCSRTHRWCKYVFF-{FreeAcid} | 968 |
| Gly-Phe-[Ala5;Leu6;Arg28]GpTx-1(1-34)-Phe-Free Acid | {H}-GFDCLGALRKCIPDNDKCCRPNLVCSRTHRWCKYVFF-{FreeAcid} | 969 |
| Gly-Tyr-[Ala5;Leu6;Arg28]GpTx-1(1-34)-Phe-Free Acid | {H}-GYDCLGALRKCIPDNDKCCRPNLVCSRTHRWCKYVFF-{FreeAcid} | 970 |
| Gly-Leu-[Ala5;Leu6;Arg28]GpTx-1(1-34)-Phe-Free Acid | {H}-GLDCLGALRKCIPDNDKCCRPNLVCSRTHRWCKYVFF-{FreeAcid} | 971 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Val-[Ala5;Leu6;Arg28]GpTx-1(1-34)-Phe-Free Acid | {H}-GVDCLGALRKCIPDNDKCCRPNLVCSRTHRWCKYVFF-{FreeAcid} | 972 |
| Gly-Ile-[Ala5;Phe6;Arg28]GpTx-1(1-34)-Phe-Free Acid | {H}-GIDCLGAFRKCIPDNDKCCRPNLVCSRTHRWCKYVFF-{FreeAcid} | 973 |
| Gly-Ala-[Ala5;Phe6;Arg28]GpTx-1(1-34)-Phe-Free Acid | {H}-GADCLGAFRKCIPDNDKCCRPNLVCSRTHRWCKYVFF-{FreeAcid} | 974 |
| Gly-Thr-[Ala5;Phe6;Arg28]GpTx-1(1-34)-Phe-Free Acid | {H}-GTDCLGAFRKCIPDNDKCCRPNLVCSRTHRWCKYVFF-{FreeAcid} | 975 |
| Gly-Ala-[Ala5;Phe6;Arg28]GpTx-1(1-34)-Phe-Free Acid | {H}-GADCLGAFRKCIPDNDKCCRPNLVCSRTHRWCKYVFF-{FreeAcid} | 976 |
| Gly-Gly-[Ala5;Phe6;Arg28]GpTx-1(1-34)-Phe-Free Acid | {H}-GGDCLGAFRKCIPDNDKCCRPNLVCSRTHRWCKYVFF-{FreeAcid} | 977 |
| Gly-Phe-[Ala5;Phe6;Arg28]GpTx-1(1-34)-Phe-Free Acid | {H}-GFDCLGAFRKCIPDNDKCCRPNLVCSRTHRWCKYVFF-{FreeAcid} | 978 |
| Gly-Tyr-[Ala5;Phe6;Arg28]GpTx-1(1-34)-Phe-Free Acid | {H}-GYDCLGAFRKCIPDNDKCCRPNLVCSRTHRWCKYVFF-{FreeAcid} | 979 |
| Gly-Leu-[Ala5;Phe6;Arg28]GpTx-1(1-34)-Phe-Free Acid | {H}-GLDCLGAFRKCIPDNDKCCRPNLVCSRTHRWCKYVFF-{FreeAcid} | 980 |
| Gly-Val-[Ala5;Phe6;Arg28]GpTx-1(1-34)-Phe-Free Acid | {H}-GVDCLGAFRKCIPDNDKCCRPNLVCSRTHRWCKYVFF-{FreeAcid} | 981 |
| Gly-Ala-[Ala5;Phe6;Gly13;Arg28]GpTx-1(1-34)-Phe-Free Acid | {H}-GADCLGAFRKCIPDGDKCCRPNLVCSRTHRWCKYVFF-{FreeAcid} | 982 |
| Gly-Ala-[Ala5;Phe6;Ser13;Arg28]GpTx-1(1-34)-Phe-Free Acid | {H}-GADCLGAFRKCIPDSDKCCRPNLVCSRTHRWCKYVFF-{FreeAcid} | 983 |
| Gly-Ala-[Ala5;Phe6;Ile13;Arg28]GpTx-1(1-34)-Phe-Free Acid | {H}-GADCLGAFRKCIPDIDKCCRPNLVCSRTHRWCKYVFF-{FreeAcid} | 984 |
| Gly-Ala-[Ala5;Phe6;Leu13;Arg28]GpTx-1(1-34)-Phe-Free Acid | {H}-GADCLGAFRKCIPDLDKCCRPNLVCSRTHRWCKYVFF-{FreeAcid} | 985 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Ala-[Ala5;Phe6;Met13;Arg28]GpTx-1(1-34)-Phe-Free Acid | {H}-GADCLGAFRKCIPDMDKCCRPNLVCSRTHRWCKYVFF-{FreeAcid} | 986 |
| Gly-Ala-[Ala5;Phe6;Val13;Arg28]GpTx-1(1-34)-Phe-Free Acid | {H}-GADCLGAFRKCIPDVDKCCRPNLVCSRTHRWCKYVFF-{FreeAcid} | 987 |
| Gly-Ala-[Ala5;Phe6;Thr13;Arg28]GpTx-1(1-34)-Phe-Free Acid | {H}-GADCLGAFRKCIPDTDKCCRPNLVCSRTHRWCKYVFF-{FreeAcid} | 988 |
| Gly-Ala-[Ala5;Phe6,13;Arg28]GpTx-1(1-34)-Phe-Free Acid | {H}-GADCLGAFRKCIPDFDKCCRPNLVCSRTHRWCKYVFF-{FreeAcid} | 989 |
| Gly-Ala-[Ala5;Phe6;Tyr13;Arg28]GpTx-1(1-34)-Phe-Free Acid | {H}-GADCLGAFRKCIPDYDKCCRPNLVCSRTHRWCKYVFF-{FreeAcid} | 990 |
| Gly-Ala-[Ala5;Leu6;Gly13;Arg28]GpTx-1(1-34)-Phe-Free Acid | {H}-GADCLGALRKCIPDGDKCCRPNLVCSRTHRWCKYVFF-{FreeAcid} | 991 |
| Gly-Ala-[Ala5;Leu6;Ser13;Arg28]GpTx-1(1-34)-Phe-Free Acid | {H}-GADCLGALRKCIPDSDKCCRPNLVCSRTHRWCKYVFF-{FreeAcid} | 992 |
| Gly-Ala-[Ala5;Leu6;Ile13;Arg28]GpTx-1(1-34)-Phe-Free Acid | {H}-GADCLGALRKCIPDIDKCCRPNLVCSRTHRWCKYVFF-{FreeAcid} | 993 |
| Gly-Ala-[Ala5;Leu6,13;Arg28]GpTx-1(1-34)-Phe-Free Acid | {H}-GADCLGALRKCIPDLDKCCRPNLVCSRTHRWCKYVFF-{FreeAcid} | 994 |
| Gly-Ala-[Ala5;Leu6;Met13;Arg28]GpTx-1(1-34)-Phe-Free Acid | {H}-GADCLGALRKCIPDMDKCCRPNLVCSRTHRWCKYVFF-{FreeAcid} | 995 |
| Gly-Ala-[Ala5;Leu6;Val13;Arg28]GpTx-1(1-34)-Phe-Free Acid | {H}-GADCLGALRKCIPDVDKCCRPNLVCSRTHRWCKYVFF-{FreeAcid} | 996 |
| Gly-Ala-[Ala5;Leu6;Thr13;Arg28]GpTx-1(1-34)-Phe-Free Acid | {H}-GADCLGALRKCIPDTDKCCRPNLVCSRTHRWCKYVFF-{FreeAcid} | 997 |
| Gly-Ala-[Ala5;Leu6;Phe13;Arg28]GpTx-1(1-34)-Phe-Free Acid | {H}-GADCLGALRKCIPDFDKCCRPNLVCSRTHRWCKYVFF-{FreeAcid} | 998 |
| Gly-Ala-[Ala5;Leu6;Tyr13;Arg28]GpTx-1(1-34)-Phe-Free Acid | {H}-GADCLGALRKCIPDYDKCCRPNLVCSRTHRWCKYVFF-{FreeAcid} | 999 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Gly-[Ser1;Ala5;Leu6;Arg28]GpTx-1(1-34)-Phe-Free Acid | {H}-GGSCLGALRKCIPDNDKCCRPNLVCSRTHRWCKYVFF-{FreeAcid} | 1000 |
| Gly-Gly-[Trp1;Ala5;Leu6;Arg28]GpTx-1(1-34)-Phe-Free Acid | {H}-GGWCLGALRKCIPDNDKCCRPNLVCSRTHRWCKYVFF-{FreeAcid} | 1001 |
| Gly-Gly-[Phe1;Ala5;Leu6;Arg28]GpTx-1(1-34)-Phe-Free Acid | {H}-GGFCLGALRKCIPDNDKCCRPNLVCSRTHRWCKYVFF-{FreeAcid} | 1002 |
| Gly-Gly-[Ile1;Ala5;Leu6;Arg28]GpTx-1(1-34)-Phe-Free Acid | {H}-GGICLGALRKCIPDNDKCCRPNLVCSRTHRWCKYVFF-{FreeAcid} | 1003 |
| Gly-Gly-Ser-[Ser1;Ala5;Leu6;Arg28]GpTx-1(1-34)-Phe-Free Acid | {H}-GGSSCLGALRKCIPDNDKCCRPNLVCSRTHRWCKYVFF-{FreeAcid} | 1004 |
| Gly-Gly-Ser-[Trp1;Ala5;Leu6;Arg28]GpTx-1(1-34)-Phe-Free Acid | {H}-GGSWCLGALRKCIPDNDKCCRPNLVCSRTHRWCKYVFF-{FreeAcid} | 1005 |
| Gly-Gly-Ser-[Phe1;Ala5;Leu6;Arg28]GpTx-1(1-34)-Phe-Free Acid | {H}-GGSFCLGALRKCIPDNDKCCRPNLVCSRTHRWCKYVFF-{FreeAcid} | 1006 |
| Gly-Gly-Ser-[Ile1;Ala5;Leu6;Arg28]GpTx-1(1-34)-Phe-Free Acid | {H}-GGSICLGALRKCIPDNDKCCRPNLVCSRTHRWCKYVFF-{FreeAcid} | 1007 |
| Gly-Gly-Gly-Gly-Ser-Gly-Gly-Gly-Gly-Ser-[Ile1;Ala5,13;Leu6;Arg28]GpTx-1(1-34)-Phe-Free Acid | {H}-GGGGSGGGGSICLGALRKCIPDADKCCRPNLVCSRTHRWCKYVFF-{FreeAcid} | 1008 |
| Gly-Gly-Gly-Gly-Ser-Gly-Gly-Gly-Gly-Ser-[Phe1;Ala5,13;Leu6;Arg28]GpTx-1(1-34)-Phe-Free Acid | {H}-GGGGSGGGGSFCLGALRKCIPDADKCCRPNLVCSRTHRWCKYVFF-{FreeAcid} | 1009 |
| Gly-Gly-Gly-Gly-Ser-Gly-Gly-Gly-Gly-Ser-[Trp1;Ala5,13;Leu6;Arg28]GpTx-1(1-34)-Phe-Free Acid | {H}-GGGGSGGGGSWCLGALRKCIPDADKCCRPNLVCSRTHRWCKYVFF-{FreeAcid} | 1010 |
| Gly-Gly-Gly-Gly-Ser-Gly-Gly-Gly-Gly-Ser-[Ile1;Ala5;Leu6;Arg28]GpTx-1(1-34)-Phe-Free Acid | {H}-GGGGSGGGGSICLGALRKCIPDNDKCCRPNLVCSRTHRWCKYVFF-{FreeAcid} | 1011 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Gly-Gly-Gly-Ser-Gly-Gly-Gly-Gly-Ser-[Phe1;Ala5;Leu6;Arg28]GpTx-1(1-34)-Phe-Free Acid | {H}-GGGGSGGGGSFCLGALRKCIPDNDKCCRPNLVCSRTHRWCKYVFF-{FreeAcid} | 1012 |
| Gly-Gly-Gly-Gly-Ser-Gly-Gly-Gly-Gly-Ser-[Trp1;Ala5;Leu6;Arg28]GpTx-1(1-34)-Phe-Free Acid | {H}-GGGGSGGGGSWCLGALRKCIPDNDKCCRPNLVCSRTHRWCKYVFF-{FreeAcid} | 1013 |
| Gly-Gly-[Ser1;Ala5;Phe6;Arg28]GpTx-1(1-34)-Phe-Free Acid | {H}-GGSCLGAFRKCIPDNDKCCRPNLVCSRTHRWCKYVFF-{FreeAcid} | 1014 |
| Gly-Gly-[Trp1;Ala5;Phe6;Arg28]GpTx-1(1-34)-Phe-Free Acid | {H}-GGWCLGAFRKCIPDNDKCCRPNLVCSRTHRWCKYVFF-{FreeAcid} | 1015 |
| Gly-Gly-[Phe1,6;Ala5;Arg28]GpTx-1(1-34)-Phe-Free Acid | {H}-GGFCLGAFRKCIPDNDKCCRPNLVCSRTHRWCKYVFF-{FreeAcid} | 1016 |
| Gly-Gly-[Ile1;Ala5;Phe6;Arg28]GpTx-1(1-34)-Phe-Free Acid | {H}-GGICLGAFRKCIPDNDKCCRPNLVCSRTHRWCKYVFF-{FreeAcid} | 1017 |
| Gly-Gly-Ser-[Ser1;Ala5;Phe6;Arg28]GpTx-1(1-34)-Phe-Free Acid | {H}-GGSSCLGAFRKCIPDNDKCCRPNLVCSRTHRWCKYVFF-{FreeAcid} | 1018 |
| Gly-Gly-Ser-[Trp1;Ala5;Phe6;Arg28]GpTx-1(1-34)-Phe-Free Acid | {H}-GGSWCLGAFRKCIPDNDKCCRPNLVCSRTHRWCKYVFF-{FreeAcid} | 1019 |
| Gly-Gly-Ser-[Phe1,6;Ala5;Arg28]GpTx-1(1-34)-Phe-Free Acid | {H}-GGSFCLGAFRKCIPDNDKCCRPNLVCSRTHRWCKYVFF-{FreeAcid} | 1020 |
| Gly-Gly-Ser-[Ile1;Ala5;Phe6;Arg28]GpTx-1(1-34)-Phe-Free Acid | {H}-GGSICLGAFRKCIPDNDKCCRPNLVCSRTHRWCKYVFF-{FreeAcid} | 1021 |
| Gly-Gly-Gly-Gly-Ser-Gly-Gly-Gly-Gly-Ser-[Ile1;Ala5,13;Phe6;Arg28]GpTx-1(1-34)-Phe-Free Acid | {H}-GGGGSGGGGSICLGAFRKCIPDADKCCRPNLVCSRTHRWCKYVFF-{FreeAcid} | 1022 |
| Gly-Gly-Gly-Gly-Ser-Gly-Gly-Gly-Gly-Ser-[Phe1,6;Ala5,13;Arg28]GpTx-1(1-34)-Phe-Free Acid | {H}-GGGGSGGGGSFCLGAFRKCIPDADKCCRPNLVCSRTHRWCKYVFF-{FreeAcid} | 1023 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| Gly-Gly-Gly-Gly-Ser-Gly-Gly-Gly-Gly-Ser-[Trp1;Ala5,13;Phe6;Arg28]GpTx-1(1-34)-Phe-Free Acid | {H}-GGGGSGGGGSWCLGAFRKCIPDADKCCRPNLVCSRTHRWCKYVFF-{FreeAcid} | 1024 |
| Gly-Gly-Gly-Gly-Ser-Gly-Gly-Gly-Gly-Ser-[Ile1;Ala5;Phe6;Arg28]GpTx-1(1-34)-Phe-Free Acid | {H}-GGGGSGGGGSICLGAFRKCIPDNDKCCRPNLVCSRTHRWCKYVFF-{FreeAcid} | 1025 |
| Gly-Gly-Gly-Gly-Ser-Gly-Gly-Gly-Gly-Ser-[Phe1,6;Ala5;Arg28]GpTx-1(1-34)-Phe-Free Acid | {H}-GGGGSGGGGSFCLGAFRKCIPDNDKCCRPNLVCSRTHRWCKYVFF-{FreeAcid} | 1026 |
| Gly-Gly-Gly-Gly-Ser-Gly-Gly-Gly-Gly-Ser-[Trp1;Ala5;Phe6;Arg28]GpTx-1(1-34)-Phe-Free Acid | {H}-GGGGSGGGGSWCLGAFRKCIPDNDKCCRPNLVCSRTHRWCKYVFF-{FreeAcid} | 1027 |
| [Ala5;Phe6;Atz13]GpTx-1(1-34) | DCLGAFRKCIPD[Atz]DKCCRPNLVCSRTHKWCKYVF-{Amide} | 1028 |
| Biotin-Ahx-[2-Abu5,13;Leu6;Arg28]GpTx-1(1-34) | {Biotin}-[Ahx]DCLG[2-Abu]LRKCIPD[2-Abu]DKCCRPNLVCSRTHRWCKYVF-{Amide} | 1029 |
| [Ala5;Phe6;Glu10;K(Biotin)13;Leu26;Arg28]GpTx-1(1-34) | {H}-DCLGAFRKCEPD[K(Biotin)]DKCCRPNLVCSRLHRWCKYVF-{Amide} | 1030 |
| Biotin-Ahx--[Ala5,Phe6,Atz13,Leu26,Arg28]GpTx-1(1-34)} | {Biotin}[Ahx]DCLGAFRKCIPD[Atz]DKCCRPNLVCSRLHRWCKYVF-{Amide} | 1031 |
| DOTA-[Ala5]GpTx-1(1-34) | {DOTA}-DCLGAMRKCIPDNDKCCRPNLVCSRTHKWCKYVF-{Amide} | 1032 |
| [Ala5;Phe6;K(DOTA)13;Leu26;Arg28]GpTx-1(1-34) | {H}-DCLGAFRKCIPDK(DOTA)DKCCRPNLVCSRLHRWCKYVF-{Amide} | 1033 |
| [Ala5,Phe6,2-Abu13,Leu26,Arg28]GpTx-1(1-34) | {H}-DCLGAFRKCIPD[2-Abu]DKCCRPNLVCSRLHRWCKYVF-{Amide} | 1034 |
| [Ala5,Phe6,Glu10,2-Abu13,Leu26,Arg28]GpTx-1(1-34) | {H}-DCLGAFRKCEPD[2-Abu]DKCCRPNLVCSRLHRWCKYVF-{Amide} | 1035 |
| [Ala5,Leu6,2-Abu13,Leu26,Arg28]GpTx-1(1-34) | {H}-DCLGALRKCIPD[2-Abu]DKCCRPNLVCSRLHRWCKYVF-{Amide} | 1036 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [Ala5,Phe6,Atz(PEG11-((2-hydroxyethyl)thio)acetamide)13, Leu26, Arg28]GpTx-1 | {H}-DCLGAFRKCIPD[Atz(PEG11-((2-hydroxyethyl)thio)acetamide)]DKCCRPNLVCSRLHRWCKYVF-{Amide} | 1037 |
| [Ala5,Phe6,Atz(PEG3-(2-hydroxyethyl)thioacetamide)13, Leu26, Arg28]GpTx-1(1-34) | {H}-DCLGAFRKCIPD[Atz(PEG3-((2-hydroxyethyl)thio)acetamide)]DKCCRPNLVCSRLHRWCKYVF-{Amide} | 1038 |
| [Ala5;Phe6;Glu10; Atz(PEG11-((2-hydroxyethyl)thio)acetamide)13; Leu26; Arg28]GpTx-1(1-34) | {H}-DCLGAFRKCEPD[Atz(PEG11-((2-hydroxyethyl)thio)acetamide)]DKCCRPNLVCSRLHRWCKYVF-{Amide} | 1039 |
| [Ala5;Phe6;Glu10; Atz(PEG3-((2-hydroxyethyl)thio)acetamide)13; Leu26; Arg28]GpTx-1(1-34) | {H}-DCLGAFRKCEPD[Atz(PEG3-((2-hydroxyethyl)thio)acetamide)]DKCCRPNLVCSRLHRWCKYVF-{Amide} | 1040 |
| ((2-Hydroxyethyl)thio)acetamide-NPEG11-triazole-[2-Abu5,13;Leu6;Arg28]GpTx-1(1-34) | {((2-Hydroxyethyl)thio)acetamide-NPEG11-triazole}-DCLG[2-Abu]LRKCIPD[2-Abu]DKCCRPNLVCSRTHRWCKYVF-{Amide} | 1041 |
| [2-Abu5,Leu6,K(ethyl-triazole-PEG11-((2-hydroxyethyl)thio)acetamide)13, Arg28]GpTx-1(1-34) | {H}-DCLG[2-Abu]LRKCIPDK(ethyl-triazole-PEG11-((2-hydroxyethyl)thio)acetamide)DKCCRPNLVCSRTHRWCKYVF-{Amide} | 1042 |
| [Ala5;Leu6,26;Atz (PEG11-((2-hydroxyethyl)thio)acetamide)13; Arg28]GpTx-1(1-34) | {H}-DCLGALRKCIPD[Atz(PEG3-((2-hydroxyethyl)thio)acetamide)]DKCCRPNLVCSRLHRWCKYVF-{Amide} | 1043 |
| [Ala5;Leu6,26;Glu10; Atz(PEG11-((2-hydroxyethyl)thio)acetamide)13; Arg28]GpTx-1(1-34) | {H}-DCLGALRKCEPD[Atz(PEG11-((2-hydroxyethyl)thio)acetamide)]DKCCRPNLVCSRLHRWCKYVF-{Amide} | 1044 |
| ((2-hydroxyethyl)thio)acetamide-NPEG11-triazole-[Ala5,Phe6,2-Abu13,Arg28]GpTx-1(1-34) | {((2-Hydroxyethyl)thio)acetamide-NPEG11-triazole}-DCLGAFRKCIPD[2-Abu]DKCCRPNLVCSRTHRWCKYVF-{Amide} | 1045 |
| [Ala5;Phe6;Atz13; Leu26;Arg28]GpTx-1(1-34) | {H}-DCLGAFRKCIPD[Atz]DKCCRPNLVCSRLHRWCKYVF-{Amide} | 1046 |
| [Ala5;Phe6;Glu10; Atz13;Leu26;Arg28]GpTx-1(1-34) | {H}-DCLGAFRKCEPD[Atz]DKCCRPNLVCSRLHRWCKYVF-{Amide} | 1047 |

TABLE 5A-continued

Amino acid sequences of GpTx-1 and GpTx-1 peptide analogs. {H}- = amino group of N-terminal; -{Amide} = amidated C-terminal; Ac- = acetylated N-terminal; -{Free Acid} = carboxylated C-terminal; {biotin}- = biotinylated N-terminal; {4-Pen}- = 4-pentynoylated N-terminal; {bromoacetamide-PEG11-triazole}- = 3-(1-(1-bromo-2-oxo-6,9,12,15,18,21,24,27,30,33,36-undecaoxa-3-azaoctatriacontan-38-yl)-1H-1,2,3-triazol-4-yl)propanoyl covalently conjugated to N-terminal.

| Designation | Amino Acid Sequence | SEQ ID NO: |
|---|---|---|
| [2-Abu5,13;Leu6;Arg28]GpTx-1(1-34 | {H}-DCLG[2-Abu]LRKCIPD[2-Abu]DKCCRPNLVCSRTHRWCKYVF-{Amide} | 1048 |
| [Ala5,Phe6,Atz(PEG11-bromoacetamide)13, Leu26,Arg28]GpTx-1 | {H}-DCLGAFRKCIPD[Atz(PEG11-bromoacetamide)]DKCCRPNLVCSRLHRWCKYVF-{Amide} | 1062 |
| [Ala5,Phe6,Atz(PEG3-bromoacetamide)13, Leu26,Arg28]GpTx-1(1-34) | {H}-DCLGAFRKCIPD[Atz(PEG3-bromoacetamide)]DKCCRPNLVCSRLHRWCKYVF-{Amide} | 1063 |
| [Ala5;Phe6;Glu10; Atz(PEG11-bromoacetamide)13; Leu26;Arg28]GpTx-1(1-34) | {H}-DCLGAFRKCEPD[Atz(PEG11-bromoacetamide)]DKCCRPNLVCSRLHRWCKYVF-{Amide} | 1064 |
| [Ala5;Phe6;Glu10; Atz(PEG3-bromoacetamide)13; Leu26;Arg28]GpTx-1(1-34) | {H}-DCLGAFRKCEPD[Atz(PEG3-bromoacetamide)]DKCCRPNLVCSRLHRWCKYVF-{Amide} | 1065 |
| bromoacetamide-PEG11-triazole-[2-Abu5,13;Leu6;Arg28]GpTx-1(1-34) | {bromoacetamide-PEG11-triazole}-DCLG[2-Abu]LRKCIPD[2-Abu]DKCCRPNLVCSRTHRWCKYVF-{Amide} | 1066 |
| [2-Abu5,Leu6,K(ethyl-triazole-PEG11-bromoacetamide)13, Arg28]GpTx-1(1-34) | {H}-DCLG[2-Abu]LRKCIPDK(ethyl-triazole-PEG11-bromoacetamide)DKCCRPNLVCSRTHRWCKYVF-{Amide} | 1067 |
| [Ala5;Leu6,26;Atz (PEG11-bromoacetamide)13; Arg28]GpTx-1(1-34) | {H}-DCLGALRKCIPD[Atz(PEG3-bromoacetamide)]DKCCRPNLVCSRLHRWCKYVF-{Amide} | 1068 |
| [Ala5;Leu6,26;Glu10; Atz(PEG11-bromoacetamide)13; Arg28]GpTx-1(1-34) | {H}-DCLGALRKCEPD[Atz(PEG11-bromoacetamide)]DKCCRPNLVCSRLHRWCKYVF-{Amide} | 1069 |
| bromoacetamide-PEG11-triazole-[Ala5,Phe6,2-Abu13,Arg28]GpTx-1(1-34) | {bromoacetamide-PEG11-triazole}-DCLGAFRKCIPD[2-Abu]DKCCRPNLVCSRTHRWCKYVF-{Amide} | 1070 |

TABLE 5B

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFMRKCIPD[2-Abu]DKCCRPNLVCSRTHEWCKYVF-{Amide} | [2-Abu13;Glu28]GpTx-1(1-34) | 1071 |
| DCLGFMRKCIPD[Pra]DKCCRPNLVCSRTHEWCKYVF-{Amide} | [Pra13;Glu28]GpTx-1(1-34) | 1072 |

TABLE 5B-continued

| Amino Acid Sequence | Designation | SEQ ID NO. |
|---|---|---|
| Amino acid sequences of GpTx-1 and GpTx-1 peptide analogs. -{Amide} = amidated C-terminal. | | |
| DCLGFMRKCIPD[2-Abu]DKCCRPNLVCSRLHEWCKYVF-{Amide} | [2-Abu13;Leu26;Glu28]GpTx-1(1-34) | 1073 |
| DCLGFMRKCIPD[Pra]DKCCRPNLVCSRLHEWCKYVF-{Amide} | [Pra13;Leu26;Glu28]GpTx-1(1-34) | 1074 |
| DCLGFMRKCIED[2-Abu]DKCCRPNLVCSRTHEWCKYVF-{Amide} | [Glu11,28;2-Abu13]GpTx-1(1-34) | 1075 |
| DCLGFMRKCEPD[2-Abu]DKCCRPNLVCSRTHEWCKYVF-{Amide} | [Glu10,28;2-Abu13]GpTx-1(1-34) | 1076 |
| DCLGFMRKCDPD[2-Abu]DKCCRPNLVCSRTHEWCKYVF-{Amide} | [Asp10;2-Abu13;Glu28]GpTx-1(1-34) | 1077 |
| DCLGFFRKCIPD[2-Abu]DKCCRPNLVCSRTHEWCKYVF-{Amide} | [Phe6;2-Abu13;Glu28]GpTx-1(1-34) | 1078 |
| DCLGFLRKCIPD[2-Abu]DKCCRPNLVCSRTHEWCKYVF-{Amide} | [Leu6;2-Abu13;Glu28]GpTx-1(1-34) | 1079 |
| DCLGF[Nle]RKCIPD[2-Abu]DKCCRPNLVCSRTHEWCKYVF-{Amide} | [Nle6;2-Abu13;Glu28]GpTx-1(1-34) | 1080 |
| DCLGGMRKCIPD[2-Abu]DKCCRPNLVCSRTHEWCKYVF-{Amide} | [Gly5;2-Abu13;Glu28]GpTx-1(1-34) | 1081 |
| DCLGAMRKCIPD[2-Abu]DKCCRPNLVCSRTHEWCKYVF-{Amide} | [Ala5;2-Abu13;Glu28]GpTx-1(1-34) | 1082 |
| DCLG[2-Abu]MRKCIPD[2-Abu]DKCCRPNLVCSRTHEWCKYVF-{Amide} | [2-Abu5,13;Glu28]GpTx-1(1-34) | 1083 |
| DCLG[Nva]MRKCIPD[2-Abu]DKCCRPNLVCSRTHEWCKYVF-{Amide} | [Nva5;2-Abu13;Glu28]GpTx-1(1-34) | 1084 |
| DCLG[Nle]MRKCIPD[2-Abu]DKCCRPNLVCSRTHEWCKYVF-{Amide} | [Nle5;2-Abu13;Glu28]GpTx-1(1-34) | 1085 |
| DCLGVMRKCIPD[2-Abu]DKCCRPNLVCSRTHEWCKYVF-{Amide} | [Val5;2-Abu13;Glu28]GpTx-1(1-34) | 1086 |
| DCLGLMRKCIPD[2-Abu]DKCCRPNLVCSRTHEWCKYVF-{Amide} | [Leu5;2-Abu13;Glu28]GpTx-1(1-34) | 1087 |
| DCLGIMRKCIPD[2-Abu]DKCCRPNLVCSRTHEWCKYVF-{Amide} | [Ile5;2-Abu13;Glu28]GpTx-1(1-34) | 1088 |
| DCLGFMRKCIED[Pra]DKCCRPNLVCSRTHEWCKYVF-{Amide} | [Glu11,28;Pra13]GpTx-1(1-34) | 1089 |
| DCLGFMRKCEPD[Pra]DKCCRPNLVCSRTHEWCKYVF-{Amide} | [Glu10,28;Pra13]GpTx-1(1-34) | 1090 |
| DCLGFMRKCDPD[Pra]DKCCRPNLVCSRTHEWCKYVF-{Amide} | [Asp10;Pra13;Glu28]GpTx-1(1-34) | 1091 |
| DCLGFFRKCIPD[Pra]DKCCRPNLVCSRTHEWCKYVF-{Amide} | [Phe6;Pra13;Glu28]GpTx-1(1-34) | 1092 |
| DCLGFLRKCIPD[Pra]DKCCRPNLVCSRTHEWCKYVF-{Amide} | [Leu6;Pra13;Glu28]GpTx-1(1-34) | 1093 |
| DCLGF[Nle]RKCIPD[Pra]DKCCRPNLVCSRTHEWCKYVF-{Amide} | [Nle6;Pra13;Glu28]GpTx-1(1-34) | 1094 |
| DCLGGMRKCIPD[Pra]DKCCRPNLVCSRTHEWCKYVF-{Amide} | [Gly5;Pra13;Glu28]GpTx-1(1-34) | 1095 |
| DCLGAMRKCIPD[Pra]DKCCRPNLVCSRTHEWCKYVF-{Amide} | [Ala5;Pra13;Glu28]GpTx-1(1-34) | 1096 |
| DCLG[2-Abu]MRKCIPD[Pra]DKCCRPNLVCSRTHEWCKYVF-{Amide} | [2-Abu5;Pra13;Glu28]GpTx-1(1-34) | 1097 |
| DCLG[Nva]MRKCIPD[Pra]DKCCRPNLVCSRTHEWCKYVF-{Amide} | [Nva5;Pra13;Glu28]GpTx-1(1-34) | 1098 |
| DCLG[Nle]MRKCIPD[Pra]DKCCRPNLVCSRTHEWCKYVF-{Amide} | [Nle5;Pra13;Glu28]GpTx-1(1-34) | 1099 |
| DCLGVMRKCIPD[Pra]DKCCRPNLVCSRTHEWCKYVF-{Amide} | [Val5;Pra13;Glu28]GpTx-1(1-34) | 1100 |
| DCLGLMRKCIPD[Pra]DKCCRPNLVCSRTHEWCKYVF-{Amide} | [Leu5;Pra13;Glu28]GpTx-1(1-34) | 1101 |
| DCLGIMRKCIPD[Pra]DKCCRPNLVCSRTHEWCKYVF-{Amide} | [Ile5;Pra13;Glu28]GpTx-1(1-34) | 1102 |
| DCLGFMRKCIED[2-Abu]DKCCRPNLVCSRLHEWCKYVF-{Amide} | [Glu11,28;2-Abu13;Leu26]GpTx-1(1-34) | 1103 |
| DCLGFMRKCEPD[2-Abu]DKCCRPNLVCSRLHEWCKYVF-{Amide} | [Glu10,28;2-Abu13;Leu26]GpTx-1(1-34) | 1104 |
| DCLGFMRKCDPD[2-Abu]DKCCRPNLVCSRLHEWCKYVF-{Amide} | [Asp10;2-Abu13;Leu26;Glu28]GpTx-1(1-34) | 1105 |
| DCLGFFRKCIPD[2-Abu]DKCCRPNLVCSRLHEWCKYVF-{Amide} | [Phe6;2-Abu13;Leu26;Glu28]GpTx-1(1-34) | 1106 |
| DCLGFLRKCIPD[2-Abu]DKCCRPNLVCSRLHEWCKYVF-{Amide} | [Leu6,26;2-Abu13;Glu28]GpTx-1(1-34) | 1107 |
| DCLGF[Nle]RKCIPD[2-Abu]DKCCRPNLVCSRLHEWCKYVF-{Amide} | [Nle6;2-Abu13;Leu26;Glu28]GpTx-1(1-34) | 1108 |
| DCLGGMRKCIPD[2-Abu]DKCCRPNLVCSRLHEWCKYVF-{Amide} | [Gly5;2-Abu13;Leu26;Glu28]GpTx-1(1-34) | 1109 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGAMRKCIPD[2-Abu]DKCCRPNLVCSRLHEWCKYVF-{Amide} | [Ala5;2-Abu13;Leu26;Glu28]GpTx-1(1-34) | 1110 |
| DCLG[2-Abu]MRKCIPD[2-Abu]DKCCRPNLVCSRLHEWCKYVF-{Amide} | [2-Abu5,13;Leu26;Glu28]GpTx-1(1-34) | 1111 |
| DCLG[Nva]MRKCIPD[2-Abu]DKCCRPNLVCSRLHEWCKYVF-{Amide} | [Nva5;2-Abu13;Leu26;Glu28]GpTx-1(1-34) | 1112 |
| DCLG[Nle]MRKCIPD[2-Abu]DKCCRPNLVCSRLHEWCKYVF-{Amide} | [Nle5;2-Abu13;Leu26;Glu28]GpTx-1(1-34) | 1113 |
| DCLGVMRKCIPD[2-Abu]DKCCRPNLVCSRLHEWCKYVF-{Amide} | [Val5;2-Abu13;Leu26;Glu28]GpTx-1(1-34) | 1114 |
| DCLGLMRKCIPD[2-Abu]DKCCRPNLVCSRLHEWCKYVF-{Amide} | [Leu5,26;2-Abu13;Glu28]GpTx-1(1-34) | 1115 |
| DCLGIMRKCIPD[2-Abu]DKCCRPNLVCSRLHEWCKYVF-{Amide} | [Ile5;2-Abu13;Leu26;Glu28]GpTx-1(1-34) | 1116 |
| DCLGFMRKCIED[Pra]DKCCRPNLVCSRLHEWCKYVF-{Amide} | [Glu11,28;Pra13;Leu26]GpTx-1(1-34) | 1117 |
| DCLGFMRKCEPD[Pra]DKCCRPNLVCSRLHEWCKYVF-{Amide} | [Glu10,28;Pra13;Leu26]GpTx-1(1-34) | 1118 |
| DCLGFMRKCDPD[Pra]DKCCRPNLVCSRLHEWCKYVF-{Amide} | [Asp10;Pra13;Leu26;Glu28]GpTx-1(1-34) | 1119 |
| DCLGFFRKCIPD[Pra]DKCCRPNLVCSRLHEWCKYVF-{Amide} | [Phe6;Pra13;Leu26;Glu28]GpTx-1(1-34) | 1120 |
| DCLGFLRKCIPD[Pra]DKCCRPNLVCSRLHEWCKYVF-{Amide} | [Leu6,26;Pra13;Glu28]GpTx-1(1-34) | 1121 |
| DCLGF[Nle]RKCIPD[Pra]DKCCRPNLVCSRLHEWCKYVF-{Amide} | [Nle6;Pra13;Leu26;Glu28]GpTx-1(1-34) | 1122 |
| DCLGGMRKCIPD[Pra]DKCCRPNLVCSRLHEWCKYVF-{Amide} | [Gly5;Pra13;Leu26;Glu28]GpTx-1(1-34) | 1123 |
| DCLGAMRKCIPD[Pra]DKCCRPNLVCSRLHEWCKYVF-{Amide} | [Ala5;Pra13;Leu26;Glu28]GpTx-1(1-34) | 1124 |
| DCLG[2-Abu]MRKCIPD[Pra]DKCCRPNLVCSRLHEWCKYVF-{Amide} | [2-Abu5;Pra13;Leu26;Glu28]GpTx-1(1-34) | 1125 |
| DCLG[Nva]MRKCIPD[Pra]DKCCRPNLVCSRLHEWCKYVF-{Amide} | [Nva5;Pra13;Leu26;Glu28]GpTx-1(1-34) | 1126 |
| DCLG[Nle]MRKCIPD[Pra]DKCCRPNLVCSRLHEWCKYVF-{Amide} | [Nle5;Pra13;Leu26;Glu28]GpTx-1(1-34) | 1127 |
| DCLGVMRKCIPD[Pra]DKCCRPNLVCSRLHEWCKYVF-{Amide} | [Val5;Pra13;Leu26;Glu28]GpTx-1(1-34) | 1128 |
| DCLGLMRKCIPD[Pra]DKCCRPNLVCSRLHEWCKYVF-{Amide} | [Leu5,26;Pra13;Glu28]GpTx-1(1-34) | 1129 |
| DCLGIMRKCIPD[Pra]DKCCRPNLVCSRLHEWCKYVF-{Amide} | [Ile5;Pra13;Leu26;Glu28]GpTx-1(1-34) | 1130 |
| DCLGFFRKCIED[2-Abu]DKCCRPNLVCSRTHEWCKYVF-{Amide} | [Phe6;Glu11,28;2-Abu13]GpTx-1(1-34) | 1131 |
| DCLGFLRKCIED[2-Abu]DKCCRPNLVCSRTHEWCKYVF-{Amide} | [Leu6;Glu11,28;2-Abu13]GpTx-1(1-34) | 1132 |
| DCLGF[Nle]RKCIED[2-Abu]DKCCRPNLVCSRTHEWCKYVF-{Amide} | [Nle6;Glu11,28;2-Abu13]GpTx-1(1-34) | 1133 |
| DCLGGMRKCIED[2-Abu]DKCCRPNLVCSRTHEWCKYVF-{Amide} | [Gly5;Glu11,28;2-Abu13]GpTx-1(1-34) | 1134 |
| DCLGAMRKCIED[2-Abu]DKCCRPNLVCSRTHEWCKYVF-{Amide} | [Ala5;Glu11,28;2-Abu13]GpTx-1(1-34) | 1135 |
| DCLG[2-Abu]MRKCIED[2-Abu]DKCCRPNLVCSRTHEWCKYVF-{Amide} | [2-Abu5,13;Glu11,28]GpTx-1(1-34) | 1136 |
| DCLG[Nva]MRKCIED[2-Abu]DKCCRPNLVCSRTHEWCKYVF-{Amide} | [Nva5;Glu11,28;2-Abu13]GpTx-1(1-34) | 1137 |
| DCLG[Nle]MRKCIED[2-Abu]DKCCRPNLVCSRTHEWCKYVF-{Amide} | [Nle5;Glu11,28;2-Abu13]GpTx-1(1-34) | 1138 |
| DCLGVMRKCIED[2-Abu]DKCCRPNLVCSRTHEWCKYVF-{Amide} | [Val5;Glu11,28;2-Abu13]GpTx-1(1-34) | 1139 |
| DCLGLMRKCIED[2-Abu]DKCCRPNLVCSRTHEWCKYVF-{Amide} | [Leu5;Glu11,28;2-Abu13]GpTx-1(1-34) | 1140 |
| DCLGIMRKCIED[2-Abu]DKCCRPNLVCSRTHEWCKYVF-{Amide} | [Ile5;Glu11,28;2-Abu13]GpTx-1(1-34) | 1141 |
| DCLGFFRKCEPD[2-Abu]DKCCRPNLVCSRTHEWCKYVF-{Amide} | [Phe6;Glu10,28;2-Abu13]GpTx-1(1-34) | 1142 |
| DCLGFLRKCEPD[2-Abu]DKCCRPNLVCSRTHEWCKYVF-{Amide} | [Leu6;Glu10,28;2-Abu13]GpTx-1(1-34) | 1143 |
| DCLGF[Nle]RKCEPD[2-Abu]DKCCRPNLVCSRTHEWCKYVF-{Amide} | [Nle6;Glu10,28;2-Abu13]GpTx-1(1-34) | 1144 |
| DCLGGMRKCEPD[2-Abu]DKCCRPNLVCSRTHEWCKYVF-{Amide} | [Gly5;Glu10,28;2-Abu13]GpTx-1(1-34) | 1145 |
| DCLGAMRKCEPD[2-Abu]DKCCRPNLVCSRTHEWCKYVF-{Amide} | [Ala5;Glu10,28;2-Abu13]GpTx-1(1-34) | 1146 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[2-Abu]MRKCEPD[2-Abu]DKCCRPNLVCSRTHEWCKYVF-{Amide} | [2-Abu5,13;Glu10,28]GpTx-1(1-34) | 1147 |
| DCLG[Nva]MRKCEPD[2-Abu]DKCCRPNLVCSRTHEWCKYVF-{Amide} | [Nva5;Glu10,28;2-Abu13]GpTx-1(1-34) | 1148 |
| DCLG[Nle]MRKCEPD[2-Abu]DKCCRPNLVCSRTHEWCKYVF-{Amide} | [Nle5;Glu10,28;2-Abu13]GpTx-1(1-34) | 1149 |
| DCLGVMRKCEPD[2-Abu]DKCCRPNLVCSRTHEWCKYVF-{Amide} | [Val5;Glu10,28;2-Abu13]GpTx-1(1-34) | 1150 |
| DCLGLMRKCEPD[2-Abu]DKCCRPNLVCSRTHEWCKYVF-{Amide} | [Leu5;Glu10,28;2-Abu13]GpTx-1(1-34) | 1151 |
| DCLGIMRKCEPD[2-Abu]DKCCRPNLVCSRTHEWCKYVF-{Amide} | [Ile5;Glu10,28;2-Abu13]GpTx-1(1-34) | 1152 |
| DCLGFFRKCDPD[2-Abu]DKCCRPNLVCSRTHEWCKYVF-{Amide} | [Phe6;Asp10;2-Abu13;Glu28]GpTx-1(1-34) | 1153 |
| DCLGFLRKCDPD[2-Abu]DKCCRPNLVCSRTHEWCKYVF-{Amide} | [Leu6;Asp10;2-Abu13;Glu28]GpTx-1(1-34) | 1154 |
| DCLGF[Nle]RKCDPD[2-Abu]DKCCRPNLVCSRTHEWCKYVF-{Amide} | [Nle6;Asp10;2-Abu13;Glu28]GpTx-1(1-34) | 1155 |
| DCLGGMRKCDPD[2-Abu]DKCCRPNLVCSRTHEWCKYVF-{Amide} | [Gly5;Asp10;2-Abu13;Glu28]GpTx-1(1-34) | 1156 |
| DCLGAMRKCDPD[2-Abu]DKCCRPNLVCSRTHEWCKYVF-{Amide} | [Ala5;Asp10;2-Abu13;Glu28]GpTx-1(1-34) | 1157 |
| DCLG[2-Abu]MRKCDPD[2-Abu]DKCCRPNLVCSRTHEWCKYVF-{Amide} | [2-Abu5,13;Asp10;Glu28]GpTx-1(1-34) | 1158 |
| DCLG[Nva]MRKCDPD[2-Abu]DKCCRPNLVCSRTHEWCKYVF-{Amide} | [Nva5;Asp10;2-Abu13;Glu28]GpTx-1(1-34) | 1159 |
| DCLG[Nle]MRKCDPD[2-Abu]DKCCRPNLVCSRTHEWCKYVF-{Amide} | [Nle5;Asp10;2-Abu13;Glu28]GpTx-1(1-34) | 1160 |
| DCLGVMRKCDPD[2-Abu]DKCCRPNLVCSRTHEWCKYVF-{Amide} | [Val5;Asp10;2-Abu13;Glu28]GpTx-1(1-34) | 1161 |
| DCLGLMRKCDPD[2-Abu]DKCCRPNLVCSRTHEWCKYVF-{Amide} | [Leu5;Asp10;2-Abu13;Glu28]GpTx-1(1-34) | 1162 |
| DCLGIMRKCDPD[2-Abu]DKCCRPNLVCSRTHEWCKYVF-{Amide} | [Ile5;Asp10;2-Abu13;Glu28]GpTx-1(1-34) | 1163 |
| DCLGGFRKCIPD[2-Abu]DKCCRPNLVCSRTHEWCKYVF-{Amide} | [Gly5;Phe6;2-Abu13;Glu28]GpTx-1(1-34) | 1164 |
| DCLGAFRKCIPD[2-Abu]DKCCRPNLVCSRTHEWCKYVF-{Amide} | [Ala5;Phe6;2-Abu13;Glu28]GpTx-1(1-34) | 1165 |
| DCLG[2-Abu]FRKCIPD[2-Abu]DKCCRPNLVCSRTHEWCKYVF-{Amide} | [2-Abu5,13;Phe6;Glu28]GpTx-1(1-34) | 1166 |
| DCLG[Nva]FRKCIPD[2-Abu]DKCCRPNLVCSRTHEWCKYVF-{Amide} | [Nva5;Phe6;2-Abu13;Glu28]GpTx-1(1-34) | 1167 |
| DCLG[Nle]FRKCIPD[2-Abu]DKCCRPNLVCSRTHEWCKYVF-{Amide} | [Nle5;Phe6;2-Abu13;Glu28]GpTx-1(1-34) | 1168 |
| DCLGVFRKCIPD[2-Abu]DKCCRPNLVCSRTHEWCKYVF-{Amide} | [Val5;Phe6;2-Abu13;Glu28]GpTx-1(1-34) | 1169 |
| DCLGLFRKCIPD[2-Abu]DKCCRPNLVCSRTHEWCKYVF-{Amide} | [Leu5;Phe6;2-Abu13;Glu28]GpTx-1(1-34) | 1170 |
| DCLGIFRKCIPD[2-Abu]DKCCRPNLVCSRTHEWCKYVF-{Amide} | [Ile5;Phe6;2-Abu13;Glu28]GpTx-1(1-34) | 1171 |
| DCLGGLRKCIPD[2-Abu]DKCCRPNLVCSRTHEWCKYVF-{Amide} | [Gly5;Leu6;2-Abu13;Glu28]GpTx-1(1-34) | 1172 |
| DCLGALRKCIPD[2-Abu]DKCCRPNLVCSRTHEWCKYVF-{Amide} | [Ala5;Leu6;2-Abu13;Glu28]GpTx-1(1-34) | 1173 |
| DCLG[2-Abu]LRKCIPD[2-Abu]DKCCRPNLVCSRTHEWCKYVF-{Amide} | [2-Abu5,13;Leu6;Glu28]GpTx-1(1-34) | 1174 |
| DCLG[Nva]LRKCIPD[2-Abu]DKCCRPNLVCSRTHEWCKYVF-{Amide} | [Nva5;Leu6;2-Abu13;Glu28]GpTx-1(1-34) | 1175 |
| DCLG[Nle]LRKCIPD[2-Abu]DKCCRPNLVCSRTHEWCKYVF-{Amide} | [Nle5;Leu6;2-Abu13;Glu28]GpTx-1(1-34) | 1176 |
| DCLGVLRKCIPD[2-Abu]DKCCRPNLVCSRTHEWCKYVF-{Amide} | [Val5;Leu6;2-Abu13;Glu28]GpTx-1(1-34) | 1177 |
| DCLGLLRKCIPD[2-Abu]DKCCRPNLVCSRTHEWCKYVF-{Amide} | [Leu5,6;2-Abu13;Glu28]GpTx-1(1-34) | 1178 |
| DCLGILRKCIPD[2-Abu]DKCCRPNLVCSRTHEWCKYVF-{Amide} | [Ile5;Leu6;2-Abu13;Glu28]GpTx-1(1-34) | 1179 |
| DCLGG[Nle]RKCIPD[2-Abu]DKCCRPNLVCSRTHEWCKYVF-{Amide} | [Gly5;Nle6;2-Abu13;Glu28]GpTx-1(1-34) | 1180 |
| DCLGA[Nle]RKCIPD[2-Abu]DKCCRPNLVCSRTHEWCKYVF-{Amide} | [Ala5;Nle6;2-Abu13;Glu28]GpTx-1(1-34) | 1181 |
| DCLG[2-Abu][Nle]RKCIPD[2-Abu]DKCCRPNLVCSRTHEWCKYVF-{Amide} | [2-Abu5,13;Nle6;Glu28]GpTx-1(1-34) | 1182 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva][Nle]RKCIPD[2-Abu]DKCCRPNLVCSRTHEWCKYVF-{Amide} | [Nva5;Nle6;2-Abu13;Glu28]GpTx-1(1-34) | 1183 |
| DCLG[Nle][Nle]RKCIPD[2-Abu]DKCCRPNLVCSRTHEWCKYVF-{Amide} | [Nle5,6;2-Abu13;Glu28]GpTx-1(1-34) | 1184 |
| DCLGV[Nle]RKCIPD[2-Abu]DKCCRPNLVCSRTHEWCKYVF-{Amide} | [Val5;Nle6;2-Abu13;Glu28]GpTx-1(1-34) | 1185 |
| DCLGL[Nle]RKCIPD[2-Abu]DKCCRPNLVCSRTHEWCKYVF-{Amide} | [Leu5;Nle6;2-Abu13;Glu28]GpTx-1(1-34) | 1186 |
| DCLGI[Nle]RKCIPD[2-Abu]DKCCRPNLVCSRTHEWCKYVF-{Amide} | [Ile5;Nle6;2-Abu13;Glu28]GpTx-1(1-34) | 1187 |
| DCLGFFRKCIED[Pra]DKCCRPNLVCSRTHEWCKYVF-{Amide} | [Phe6;Glu11,28;Pra13]GpTx-1(1-34) | 1188 |
| DCLGFLRKCIED[Pra]DKCCRPNLVCSRTHEWCKYVF-{Amide} | [Leu6;Glu11,28;Pra13]GpTx-1(1-34) | 1189 |
| DCLGF[Nle]RKCIED[Pra]DKCCRPNLVCSRTHEWCKYVF-{Amide} | [Nle6;Glu11,28;Pra13]GpTx-1(1-34) | 1190 |
| DCLGGMRKCIED[Pra]DKCCRPNLVCSRTHEWCKYVF-{Amide} | [Gly5;Glu11,28;Pra13]GpTx-1(1-34) | 1191 |
| DCLGAMRKCIED[Pra]DKCCRPNLVCSRTHEWCKYVF-{Amide} | [Ala5;Glu11,28;Pra13]GpTx-1(1-34) | 1192 |
| DCLG[2-Abu]MRKCIED[Pra]DKCCRPNLVCSRTHEWCKYVF-{Amide} | [2-Abu5;Glu11,28;Pra13]GpTx-1(1-34) | 1193 |
| DCLG[Nva]MRKCIED[Pra]DKCCRPNLVCSRTHEWCKYVF-{Amide} | [Nva5;Glu11,28;Pra13]GpTx-1(1-34) | 1194 |
| DCLG[Nle]MRKCIED[Pra]DKCCRPNLVCSRTHEWCKYVF-{Amide} | [Nle5;Glu11,28;Pra13]GpTx-1(1-34) | 1195 |
| DCLGVMRKCIED[Pra]DKCCRPNLVCSRTHEWCKYVF-{Amide} | [Val5;Glu11,28;Pra13]GpTx-1(1-34) | 1196 |
| DCLGLMRKCIED[Pra]DKCCRPNLVCSRTHEWCKYVF-{Amide} | [Leu5;Glu11,28;Pra13]GpTx-1(1-34) | 1197 |
| DCLGIMRKCIED[Pra]DKCCRPNLVCSRTHEWCKYVF-{Amide} | [Ile5;Glu11,28;Pra13]GpTx-1(1-34) | 1198 |
| DCLGFFRKCEPD[Pra]DKCCRPNLVCSRTHEWCKYVF-{Amide} | [Phe6;Glu10,28;Pra13]GpTx-1(1-34) | 1199 |
| DCLGFLRKCEPD[Pra]DKCCRPNLVCSRTHEWCKYVF-{Amide} | [Leu6;Glu10,28;Pra13]GpTx-1(1-34) | 1200 |
| DCLGF[Nle]RKCEPD[Pra]DKCCRPNLVCSRTHEWCKYVF-{Amide} | [Nle6;Glu10,28;Pra13]GpTx-1(1-34) | 1201 |
| DCLGGMRKCEPD[Pra]DKCCRPNLVCSRTHEWCKYVF-{Amide} | [Gly5;Glu10,28;Pra13]GpTx-1(1-34) | 1202 |
| DCLGAMRKCEPD[Pra]DKCCRPNLVCSRTHEWCKYVF-{Amide} | [Ala5;Glu10,28;Pra13]GpTx-1(1-34) | 1203 |
| DCLG[2-Abu]MRKCEPD[Pra]DKCCRPNLVCSRTHEWCKYVF-{Amide} | [2-Abu5;Glu10,28;Pra13]GpTx-1(1-34) | 1204 |
| DCLG[Nva]MRKCEPD[Pra]DKCCRPNLVCSRTHEWCKYVF-{Amide} | [Nva5;Glu10,28;Pra13]GpTx-1(1-34) | 1205 |
| DCLG[Nle]MRKCEPD[Pra]DKCCRPNLVCSRTHEWCKYVF-{Amide} | [Nle5;Glu10,28;Pra13]GpTx-1(1-34) | 1206 |
| DCLGVMRKCEPD[Pra]DKCCRPNLVCSRTHEWCKYVF-{Amide} | [Val5;Glu10,28;Pra13]GpTx-1(1-34) | 1207 |
| DCLGLMRKCEPD[Pra]DKCCRPNLVCSRTHEWCKYVF-{Amide} | [Leu5;Glu10,28;Pra13]GpTx-1(1-34) | 1208 |
| DCLGIMRKCEPD[Pra]DKCCRPNLVCSRTHEWCKYVF-{Amide} | [Ile5;Glu10,28;Pra13]GpTx-1(1-34) | 1209 |
| DCLGFFRKCDPD[Pra]DKCCRPNLVCSRTHEWCKYVF-{Amide} | [Phe6;Asp10;Pra13;Glu28]GpTx-1(1-34) | 1210 |
| DCLGFLRKCDPD[Pra]DKCCRPNLVCSRTHEWCKYVF-{Amide} | [Leu6;Asp10;Pra13;Glu28]GpTx-1(1-34) | 1211 |
| DCLGF[Nle]RKCDPD[Pra]DKCCRPNLVCSRTHEWCKYVF-{Amide} | [Nle6;Asp10;Pra13;Glu28]GpTx-1(1-34) | 1212 |
| DCLGGMRKCDPD[Pra]DKCCRPNLVCSRTHEWCKYVF-{Amide} | [Gly5;Asp10;Pra13;Glu28]GpTx-1(1-34) | 1213 |
| DCLGAMRKCDPD[Pra]DKCCRPNLVCSRTHEWCKYVF-{Amide} | [Ala5;Asp10;Pra13;Glu28]GpTx-1(1-34) | 1214 |
| DCLG[2-Abu]MRKCDPD[Pra]DKCCRPNLVCSRTHEWCKYVF-{Amide} | [2-Abu5;Asp10;Pra13;Glu28]GpTx-1(1-34) | 1215 |
| DCLG[Nva]MRKCDPD[Pra]DKCCRPNLVCSRTHEWCKYVF-{Amide} | [Nva5;Asp10;Pra13;Glu28]GpTx-1(1-34) | 1216 |
| DCLG[Nle]MRKCDPD[Pra]DKCCRPNLVCSRTHEWCKYVF-{Amide} | [Nle5;Asp10;Pra13;Glu28]GpTx-1(1-34) | 1217 |
| DCLGVMRKCDPD[Pra]DKCCRPNLVCSRTHEWCKYVF-{Amide} | [Val5;Asp10;Pra13;Glu28]GpTx-1(1-34) | 1218 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGLMRKCDPD[Pra]DKCCRPNLVCSRTHEWCKYVF-{Amide} | [Leu5;Asp10;Pra13;Glu28]GpTx-1(1-34) | 1219 |
| DCLGIMRKCDPD[Pra]DKCCRPNLVCSRTHEWCKYVF-{Amide} | [Ile5;Asp10;Pra13;Glu28]GpTx-1(1-34) | 1220 |
| DCLGGFRKCIPD[Pra]DKCCRPNLVCSRTHEWCKYVF-{Amide} | [Gly5;Phe6;Pra13;Glu28]GpTx-1(1-34) | 1221 |
| DCLGAFRKCIPD[Pra]DKCCRPNLVCSRTHEWCKYVF-{Amide} | [Ala5;Phe6;Pra13;Glu28]GpTx-1(1-34) | 1222 |
| DCLG[2-Abu]FRKCIPD[Pra]DKCCRPNLVCSRTHEWCKYVF-{Amide} | [2-Abu5;Phe6;Pra13;Glu28]GpTx-1(1-34) | 1223 |
| DCLG[Nva]FRKCIPD[Pra]DKCCRPNLVCSRTHEWCKYVF-{Amide} | [Nva5;Phe6;Pra13;Glu28]GpTx-1(1-34) | 1224 |
| DCLG[Nle]FRKCIPD[Pra]DKCCRPNLVCSRTHEWCKYVF-{Amide} | [Nle5;Phe6;Pra13;Glu28]GpTx-1(1-34) | 1225 |
| DCLGVFRKCIPD[Pra]DKCCRPNLVCSRTHEWCKYVF-{Amide} | [Val5;Phe6;Pra13;Glu28]GpTx-1(1-34) | 1226 |
| DCLGLFRKCIPD[Pra]DKCCRPNLVCSRTHEWCKYVF-{Amide} | [Leu5;Phe6;Pra13;Glu28]GpTx-1(1-34) | 1227 |
| DCLGIFRKCIPD[Pra]DKCCRPNLVCSRTHEWCKYVF-{Amide} | [Ile5;Phe6;Pra13;Glu28]GpTx-1(1-34) | 1228 |
| DCLGGLRKCIPD[Pra]DKCCRPNLVCSRTHEWCKYVF-{Amide} | [Gly5;Leu6;Pra13;Glu28]GpTx-1(1-34) | 1229 |
| DCLGALRKCIPD[Pra]DKCCRPNLVCSRTHEWCKYVF-{Amide} | [Ala5;Leu6;Pra13;Glu28]GpTx-1(1-34) | 1230 |
| DCLG[2-Abu]LRKCIPD[Pra]DKCCRPNLVCSRTHEWCKYVF-{Amide} | [2-Abu5;Leu6;Pra13;Glu28]GpTx-1(1-34) | 1231 |
| DCLG[Nva]LRKCIPD[Pra]DKCCRPNLVCSRTHEWCKYVF-{Amide} | [Nva5;Leu6;Pra13;Glu28]GpTx-1(1-34) | 1232 |
| DCLG[Nle]LRKCIPD[Pra]DKCCRPNLVCSRTHEWCKYVF-{Amide} | [Nle5;Leu6;Pra13;Glu28]GpTx-1(1-34) | 1233 |
| DCLGVLRKCIPD[Pra]DKCCRPNLVCSRTHEWCKYVF-{Amide} | [Val5;Leu6;Pra13;Glu28]GpTx-1(1-34) | 1234 |
| DCLGLLRKCIPD[Pra]DKCCRPNLVCSRTHEWCKYVF-{Amide} | [Leu5,6;Pra13;Glu28]GpTx-1(1-34) | 1235 |
| DCLGILRKCIPD[Pra]DKCCRPNLVCSRTHEWCKYVF-{Amide} | [Ile5;Leu6;Pra13;Glu28]GpTx-1(1-34) | 1236 |
| DCLGG[Nle]RKCIPD[Pra]DKCCRPNLVCSRTHEWCKYVF-{Amide} | [Gly5;Nle6;Pra13;Glu28]GpTx-1(1-34) | 1237 |
| DCLGA[Nle]RKCIPD[Pra]DKCCRPNLVCSRTHEWCKYVF-{Amide} | [Ala5;Nle6;Pra13;Glu28]GpTx-1(1-34) | 1238 |
| DCLG[2-Abu][Nle]RKCIPD[Pra]DKCCRPNLVCSRTHEWCKYVF-{Amide} | [2-Abu5;Nle6;Pra13;Glu28]GpTx-1(1-34) | 1239 |
| DCLG[Nva][Nle]RKCIPD[Pra]DKCCRPNLVCSRTHEWCKYVF-{Amide} | [Nva5;Nle6;Pra13;Glu28]GpTx-1(1-34) | 1240 |
| DCLG[Nle][Nle]RKCIPD[Pra]DKCCRPNLVCSRTHEWCKYVF-{Amide} | [Nle5,6;Pra13;Glu28]GpTx-1(1-34) | 1241 |
| DCLGV[Nle]RKCIPD[Pra]DKCCRPNLVCSRTHEWCKYVF-{Amide} | [Val5;Nle6;Pra13;Glu28]GpTx-1(1-34) | 1242 |
| DCLGL[Nle]RKCIPD[Pra]DKCCRPNLVCSRTHEWCKYVF-{Amide} | [Leu5;Nle6;Pra13;Glu28]GpTx-1(1-34) | 1243 |
| DCLGI[Nle]RKCIPD[Pra]DKCCRPNLVCSRTHEWCKYVF-{Amide} | [Ile5;Nle6;Pra13;Glu28]GpTx-1(1-34) | 1244 |
| DCLGFFRKCIED[2-Abu]DKCCRPNLVCSRLHEWCKYVF-{Amide} | [Phe6;Glu11,28;2-Abu13;Leu26]GpTx-1(1-34) | 1245 |
| DCLGFLRKCIED[2-Abu]DKCCRPNLVCSRLHEWCKYVF-{Amide} | [Leu6,26;Glu11,28;2-Abu13]GpTx-1(1-34) | 1246 |
| DCLGF[Nle]RKCIED[2-Abu]DKCCRPNLVCSRLHEWCKYVF-{Amide} | [Nle6;Glu11,28;2-Abu13;Leu26]GpTx-1(1-34) | 1247 |
| DCLGGMRKCIED[2-Abu]DKCCRPNLVCSRLHEWCKYVF-{Amide} | [Gly5;Glu11,28;2-Abu13;Leu26]GpTx-1(1-34) | 1248 |
| DCLGAMRKCIED[2-Abu]DKCCRPNLVCSRLHEWCKYVF-{Amide} | [Ala5;Glu11,28;2-Abu13;Leu26]GpTx-1(1-34) | 1249 |
| DCLG[2-Abu]MRKCIED[2-Abu]DKCCRPNLVCSRLHEWCKYVF-{Amide} | [2-Abu5,13;Glu11,28;Leu26]GpTx-1(1-34) | 1250 |
| DCLG[Nva]MRKCIED[2-Abu]DKCCRPNLVCSRLHEWCKYVF-{Amide} | [Nva5;Glu11,28;2-Abu13;Leu26]GpTx-1(1-34) | 1251 |
| DCLG[Nle]MRKCIED[2-Abu]DKCCRPNLVCSRLHEWCKYVF-{Amide} | [Nle5;Glu11,28;2-Abu13;Leu26]GpTx-1(1-34) | 1252 |
| DCLGVMRKCIED[2-Abu]DKCCRPNLVCSRLHEWCKYVF-{Amide} | [Val5;Glu11,28;2-Abu13;Leu26]GpTx-1(1-34) | 1253 |
| DCLGLMRKCIED[2-Abu]DKCCRPNLVCSRLHEWCKYVF-{Amide} | [Leu5,26;Glu11,28;2-Abu13]GpTx-1(1-34) | 1254 |
| DCLGIMRKCIED[2-Abu]DKCCRPNLVCSRLHEWCKYVF-{Amide} | [Ile5;Glu11,28;2-Abu13;Leu26]GpTx-1(1-34) | 1255 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFFRKCEPD[2-Abu]DKCCRPNLVCSRLHEWCKYVF-{Amide} | [Phe6;Glu10,28;2-Abu13;Leu26]GpTx-1(1-34) | 1256 |
| DCLGFLRKCEPD[2-Abu]DKCCRPNLVCSRLHEWCKYVF-{Amide} | [Leu6,26;Glu10,28;2-Abu13]GpTx-1(1-34) | 1257 |
| DCLGF[Nle]RKCEPD[2-Abu]DKCCRPNLVCSRLHEWCKYVF-{Amide} | [Nle6;Glu10,28;2-Abu13;Leu26]GpTx-1(1-34) | 1258 |
| DCLGGMRKCEPD[2-Abu]DKCCRPNLVCSRLHEWCKYVF-{Amide} | [Gly5;Glu10,28;2-Abu13;Leu26]GpTx-1(1-34) | 1259 |
| DCLGAMRKCEPD[2-Abu]DKCCRPNLVCSRLHEWCKYVF-{Amide} | [Ala5;Glu10,28;2-Abu13;Leu26]GpTx-1(1-34) | 1260 |
| DCLG[2-Abu]MRKCEPD[2-Abu]DKCCRPNLVCSRLHEWCKYVF-{Amide} | [2-Abu5,13;Glu10,28;Leu26]GpTx-1(1-34) | 1261 |
| DCLG[Nva]MRKCEPD[2-Abu]DKCCRPNLVCSRLHEWCKYVF-{Amide} | [Nva5;Glu10,28;2-Abu13;Leu26]GpTx-1(1-34) | 1262 |
| DCLG[Nle]MRKCEPD[2-Abu]DKCCRPNLVCSRLHEWCKYVF-{Amide} | [Nle5;Glu10,28;2-Abu13;Leu26]GpTx-1(1-34) | 1263 |
| DCLGVMRKCEPD[2-Abu]DKCCRPNLVCSRLHEWCKYVF-{Amide} | [Val5;Glu10,28;2-Abu13;Leu26]GpTx-1(1-34) | 1264 |
| DCLGLMRKCEPD[2-Abu]DKCCRPNLVCSRLHEWCKYVF-{Amide} | [Leu5,26;Glu10,28;2-Abu13]GpTx-1(1-34) | 1265 |
| DCLGIMRKCEPD[2-Abu]DKCCRPNLVCSRLHEWCKYVF-{Amide} | [Ile5;Glu10,28;2-Abu13;Leu26]GpTx-1(1-34) | 1266 |
| DCLGFFRKCDPD[2-Abu]DKCCRPNLVCSRLHEWCKYVF-{Amide} | [Phe6;Asp10;2-Abu13;Leu26;Glu28]GpTx-1(1-34) | 1267 |
| DCLGFLRKCDPD[2-Abu]DKCCRPNLVCSRLHEWCKYVF-{Amide} | [Leu6,26;Asp10;2-Abu13;Glu28]GpTx-1(1-34) | 1268 |
| DCLGF[Nle]RKCDPD[2-Abu]DKCCRPNLVCSRLHEWCKYVF-{Amide} | [Nle6;Asp10;2-Abu13;Leu26;Glu28]GpTx-1(1-34) | 1269 |
| DCLGGMRKCDPD[2-Abu]DKCCRPNLVCSRLHEWCKYVF-{Amide} | [Gly5;Asp10;2-Abu13;Leu26;Glu28]GpTx-1(1-34) | 1270 |
| DCLGAMRKCDPD[2-Abu]DKCCRPNLVCSRLHEWCKYVF-{Amide} | [Ala5;Asp10;2-Abu13;Leu26;Glu28]GpTx-1(1-34) | 1271 |
| DCLG[2-Abu]MRKCDPD[2-Abu]DKCCRPNLVCSRLHEWCKYVF-{Amide} | [2-Abu5,13;Asp10;Leu26;Glu28]GpTx-1(1-34) | 1272 |
| DCLG[Nva]MRKCDPD[2-Abu]DKCCRPNLVCSRLHEWCKYVF-{Amide} | [Nva5;Asp10;2-Abu13;Leu26;Glu28]GpTx-1(1-34) | 1273 |
| DCLG[Nle]MRKCDPD[2-Abu]DKCCRPNLVCSRLHEWCKYVF-{Amide} | [Nle5;Asp10;2-Abu13;Leu26;Glu28]GpTx-1(1-34) | 1274 |
| DCLGVMRKCDPD[2-Abu]DKCCRPNLVCSRLHEWCKYVF-{Amide} | [Val5;Asp10;2-Abu13;Leu26;Glu28]GpTx-1(1-34) | 1275 |
| DCLGLMRKCDPD[2-Abu]DKCCRPNLVCSRLHEWCKYVF-{Amide} | [Leu5,26;Asp10;2-Abu13;Glu28]GpTx-1(1-34) | 1276 |
| DCLGIMRKCDPD[2-Abu]DKCCRPNLVCSRLHEWCKYVF-{Amide} | [Ile5;Asp10;2-Abu13;Leu26;Glu28]GpTx-1(1-34) | 1277 |
| DCLGGFRKCIPD[2-Abu]DKCCRPNLVCSRLHEWCKYVF-{Amide} | [Gly5;Phe6;2-Abu13;Leu26;Glu28]GpTx-1(1-34) | 1278 |
| DCLGAFRKCIPD[2-Abu]DKCCRPNLVCSRLHEWCKYVF-{Amide} | [Ala5;Phe6;2-Abu13;Leu26;Glu28]GpTx-1(1-34) | 1279 |
| DCLG[2-Abu]FRKCIPD[2-Abu]DKCCRPNLVCSRLHEWCKYVF-{Amide} | [2-Abu5,13;Phe6;Leu26;Glu28]GpTx-1(1-34) | 1280 |
| DCLG[Nva]FRKCIPD[2-Abu]DKCCRPNLVCSRLHEWCKYVF-{Amide} | [Nva5;Phe6;2-Abu13;Leu26;Glu28]GpTx-1(1-34) | 1281 |
| DCLG[Nle]FRKCIPD[2-Abu]DKCCRPNLVCSRLHEWCKYVF-{Amide} | [Nle5;Phe6;2-Abu13;Leu26;Glu28]GpTx-1(1-34) | 1282 |
| DCLGVFRKCIPD[2-Abu]DKCCRPNLVCSRLHEWCKYVF-{Amide} | [Val5;Phe6;2-Abu13;Leu26;Glu28]GpTx-1(1-34) | 1283 |
| DCLGLFRKCIPD[2-Abu]DKCCRPNLVCSRLHEWCKYVF-{Amide} | [Leu5,26;Phe6;2-Abu13;Glu28]GpTx-1(1-34) | 1284 |
| DCLGIFRKCIPD[2-Abu]DKCCRPNLVCSRLHEWCKYVF-{Amide} | [Ile5;Phe6;2-Abu13;Leu26;Glu28]GpTx-1(1-34) | 1285 |
| DCLGGLRKCIPD[2-Abu]DKCCRPNLVCSRLHEWCKYVF-{Amide} | [Gly5;Leu6,26;2-Abu13;Glu28]GpTx-1(1-34) | 1286 |
| DCLGALRKCIPD[2-Abu]DKCCRPNLVCSRLHEWCKYVF-{Amide} | [Ala5;Leu6,26;2-Abu13;Glu28]GpTx-1(1-34) | 1287 |
| DCLG[2-Abu]LRKCIPD[2-Abu]DKCCRPNLVCSRLHEWCKYVF-{Amide} | [2-Abu5,13;Leu6,26;Glu28]GpTx-1(1-34) | 1288 |
| DCLG[Nva]LRKCIPD[2-Abu]DKCCRPNLVCSRLHEWCKYVF-{Amide} | [Nva5;Leu6,26;2-Abu13;Glu28]GpTx-1(1-34) | 1289 |
| DCLG[Nle]LRKCIPD[2-Abu]DKCCRPNLVCSRLHEWCKYVF-{Amide} | [Nle5;Leu6,26;2-Abu13;Glu28]GpTx-1(1-34) | 1290 |
| DCLGVLRKCIPD[2-Abu]DKCCRPNLVCSRLHEWCKYVF-{Amide} | [Val5;Leu6,26;2-Abu13;Glu28]GpTx-1(1-34) | 1291 |
| DCLGLLRKCIPD[2-Abu]DKCCRPNLVCSRLHEWCKYVF-{Amide} | [Leu5,6,26;2-Abu13;Glu28]GpTx-1(1-34) | 1292 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGILRKCIPD[2-Abu]DKCCRPNLVCSRLHEWCKYVF-{Amide} | [Ile5;Leu6,26;2-Abu13;Glu28]GpTx-1(1-34) | 1293 |
| DCLGG[Nle]RKCIPD[2-Abu]DKCCRPNLVCSRLHEWCKYVF-{Amide} | [Gly5;Nle6;2-Abu13;Leu26;Glu28]GpTx-1(1-34) | 1294 |
| DCLGA[Nle]RKCIPD[2-Abu]DKCCRPNLVCSRLHEWCKYVF-{Amide} | [Ala5;Nle6;2-Abu13;Leu26;Glu28]GpTx-1(1-34) | 1295 |
| DCLG[2-Abu][Nle]RKCIPD[2-Abu]DKCCRPNLVCSRLHEWCKYVF-{Amide} | [2-Abu5,13;Nle6;Leu26;Glu28]GpTx-1(1-34) | 1296 |
| DCLG[Nva][Nle]RKCIPD[2-Abu]DKCCRPNLVCSRLHEWCKYVF-{Amide} | [Nva5;Nle6;2-Abu13;Leu26;Glu28]GpTx-1(1-34) | 1297 |
| DCLG[Nle][Nle]RKCIPD[2-Abu]DKCCRPNLVCSRLHEWCKYVF-{Amide} | [Nle5,6;2-Abu13;Leu26;Glu28]GpTx-1(1-34) | 1298 |
| DCLGV[Nle]RKCIPD[2-Abu]DKCCRPNLVCSRLHEWCKYVF-{Amide} | [Val5;Nle6;2-Abu13;Leu26;Glu28]GpTx-1(1-34) | 1299 |
| DCLGL[Nle]RKCIPD[2-Abu]DKCCRPNLVCSRLHEWCKYVF-{Amide} | [Leu5,26;Nle6;2-Abu13;Glu28]GpTx-1(1-34) | 1300 |
| DCLGI[Nle]RKCIPD[2-Abu]DKCCRPNLVCSRLHEWCKYVF-{Amide} | [Ile5;Nle6;2-Abu13;Leu26;Glu28]GpTx-1(1-34) | 1301 |
| DCLGFFRKCIED[Pra]DKCCRPNLVCSRLHEWCKYVF-{Amide} | [Phe6;Glu11,28;Pra13;Leu26]GpTx-1(1-34) | 1302 |
| DCLGFLRKCIED[Pra]DKCCRPNLVCSRLHEWCKYVF-{Amide} | [Leu6,26;Glu11,28;Pra13]GpTx-1(1-34) | 1303 |
| DCLGF[Nle]RKCIED[Pra]DKCCRPNLVCSRLHEWCKYVF-{Amide} | [Nle6;Glu11,28;Pra13;Leu26]GpTx-1(1-34) | 1304 |
| DCLGGMRKCIED[Pra]DKCCRPNLVCSRLHEWCKYVF-{Amide} | [Gly5;Glu11,28;Pra13;Leu26]GpTx-1(1-34) | 1305 |
| DCLGAMRKCIED[Pra]DKCCRPNLVCSRLHEWCKYVF-{Amide} | [Ala5;Glu11,28;Pra13;Leu26]GpTx-1(1-34) | 1306 |
| DCLG[2-Abu]MRKCIED[Pra]DKCCRPNLVCSRLHEWCKYVF-{Amide} | [2-Abu5;Glu11,28;Pra13;Leu26]GpTx-1(1-34) | 1307 |
| DCLG[Nva]MRKCIED[Pra]DKCCRPNLVCSRLHEWCKYVF-{Amide} | [Nva5;Glu11,28;Pra13;Leu26]GpTx-1(1-34) | 1308 |
| DCLG[Nle]MRKCIED[Pra]DKCCRPNLVCSRLHEWCKYVF-{Amide} | [Nle5;Glu11,28;Pra13;Leu26]GpTx-1(1-34) | 1309 |
| DCLGVMRKCIED[Pra]DKCCRPNLVCSRLHEWCKYVF-{Amide} | [Val5;Glu11,28;Pra13;Leu26]GpTx-1(1-34) | 1310 |
| DCLGLMRKCIED[Pra]DKCCRPNLVCSRLHEWCKYVF-{Amide} | [Leu5,26;Glu11,28;Pra13]GpTx-1(1-34) | 1311 |
| DCLGIMRKCIED[Pra]DKCCRPNLVCSRLHEWCKYVF-{Amide} | [Ile5;Glu11,28;Pra13;Leu26]GpTx-1(1-34) | 1312 |
| DCLGFFRKCEPD[Pra]DKCCRPNLVCSRLHEWCKYVF-{Amide} | [Phe6;Glu10,28;Pra13;Leu26]GpTx-1(1-34) | 1313 |
| DCLGFLRKCEPD[Pra]DKCCRPNLVCSRLHEWCKYVF-{Amide} | [Leu6,26;Glu10,28;Pra13]GpTx-1(1-34) | 1314 |
| DCLGF[Nle]RKCEPD[Pra]DKCCRPNLVCSRLHEWCKYVF-{Amide} | [Nle6;Glu10,28;Pra13;Leu26]GpTx-1(1-34) | 1315 |
| DCLGGMRKCEPD[Pra]DKCCRPNLVCSRLHEWCKYVF-{Amide} | [Gly5;Glu10,28;Pra13;Leu26]GpTx-1(1-34) | 1316 |
| DCLGAMRKCEPD[Pra]DKCCRPNLVCSRLHEWCKYVF-{Amide} | [Ala5;Glu10,28;Pra13;Leu26]GpTx-1(1-34) | 1317 |
| DCLG[2-Abu]MRKCEPD[Pra]DKCCRPNLVCSRLHEWCKYVF-{Amide} | [2-Abu5;Glu10,28;Pra13;Leu26]GpTx-1(1-34) | 1318 |
| DCLG[Nva]MRKCEPD[Pra]DKCCRPNLVCSRLHEWCKYVF-{Amide} | [Nva5;Glu10,28;Pra13;Leu26]GpTx-1(1-34) | 1319 |
| DCLG[Nle]MRKCEPD[Pra]DKCCRPNLVCSRLHEWCKYVF-{Amide} | [Nle5;Glu10,28;Pra13;Leu26]GpTx-1(1-34) | 1320 |
| DCLGVMRKCEPD[Pra]DKCCRPNLVCSRLHEWCKYVF-{Amide} | [Val5;Glu10,28;Pra13;Leu26]GpTx-1(1-34) | 1321 |
| DCLGLMRKCEPD[Pra]DKCCRPNLVCSRLHEWCKYVF-{Amide} | [Leu5,26;Glu10,28;Pra13]GpTx-1(1-34) | 1322 |
| DCLGIMRKCEPD[Pra]DKCCRPNLVCSRLHEWCKYVF-{Amide} | [Ile5;Glu10,28;Pra13;Leu26]GpTx-1(1-34) | 1323 |
| DCLGFFRKCDPD[Pra]DKCCRPNLVCSRLHEWCKYVF-{Amide} | [Phe6;Asp10;Pra13;Leu26;Glu28]GpTx-1(1-34) | 1324 |
| DCLGFLRKCDPD[Pra]DKCCRPNLVCSRLHEWCKYVF-{Amide} | [Leu6,26;Asp10;Pra13;Glu28]GpTx-1(1-34) | 1325 |
| DCLGF[Nle]RKCDPD[Pra]DKCCRPNLVCSRLHEWCKYVF-{Amide} | [Nle6;Asp10;Pra13;Leu26;Glu28]GpTx-1(1-34) | 1326 |
| DCLGGMRKCDPD[Pra]DKCCRPNLVCSRLHEWCKYVF-{Amide} | [Gly5;Asp10;Pra13;Leu26;Glu28]GpTx-1(1-34) | 1327 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGAMRKCDPD[Pra]DKCCRPNLVCSRLHEWCKYVF-{Amide} | [Ala5;Asp10;Pra13;Leu26;Glu28]GpTx-1(1-34) | 1328 |
| DCLG[2-Abu]MRKCDPD[Pra]DKCCRPNLVCSRLHEWCKYVF-{Amide} | [2-Abu5;Asp10;Pra13;Leu26;Glu28]GpTx-1(1-34) | 1329 |
| DCLG[Nva]MRKCDPD[Pra]DKCCRPNLVCSRLHEWCKYVF-{Amide} | [Nva5;Asp10;Pra13;Leu26;Glu28]GpTx-1(1-34) | 1330 |
| DCLG[Nle]MRKCDPD[Pra]DKCCRPNLVCSRLHEWCKYVF-{Amide} | [Nle5;Asp10;Pra13;Leu26;Glu28]GpTx-1(1-34) | 1331 |
| DCLGVMRKCDPD[Pra]DKCCRPNLVCSRLHEWCKYVF-{Amide} | [Val5;Asp10;Pra13;Leu26;Glu28]GpTx-1(1-34) | 1332 |
| DCLGLMRKCDPD[Pra]DKCCRPNLVCSRLHEWCKYVF-{Amide} | [Leu5,26;Asp10;Pra13;Glu28]GpTx-1(1-34) | 1333 |
| DCLGIMRKCDPD[Pra]DKCCRPNLVCSRLHEWCKYVF-{Amide} | [Ile5;Asp10;Pra13;Leu26;Glu28]GpTx-1(1-34) | 1334 |
| DCLGGFRKCIPD[Pra]DKCCRPNLVCSRLHEWCKYVF-{Amide} | [Gly5;Phe6;Pra13;Leu26;Glu28]GpTx-1(1-34) | 1335 |
| DCLGAFRKCIPD[Pra]DKCCRPNLVCSRLHEWCKYVF-{Amide} | [Ala5;Phe6;Pra13;Leu26;Glu28]GpTx-1(1-34) | 1336 |
| DCLG[2-Abu]FRKCIPD[Pra]DKCCRPNLVCSRLHEWCKYVF-{Amide} | [2-Abu5;Phe6;Pra13;Leu26;Glu28]GpTx-1(1-34) | 1337 |
| DCLG[Nva]FRKCIPD[Pra]DKCCRPNLVCSRLHEWCKYVF-{Amide} | [Nva5;Phe6;Pra13;Leu26;Glu28]GpTx-1(1-34) | 1338 |
| DCLG[Nle]FRKCIPD[Pra]DKCCRPNLVCSRLHEWCKYVF-{Amide} | [Nle5;Phe6;Pra13;Leu26;Glu28]GpTx-1(1-34) | 1339 |
| DCLGVFRKCIPD[Pra]DKCCRPNLVCSRLHEWCKYVF-{Amide} | [Val5;Phe6;Pra13;Leu26;Glu28]GpTx-1(1-34) | 1340 |
| DCLGLFRKCIPD[Pra]DKCCRPNLVCSRLHEWCKYVF-{Amide} | [Leu5,26;Phe6;Pra13;Glu28]GpTx-1(1-34) | 1341 |
| DCLGIFRKCIPD[Pra]DKCCRPNLVCSRLHEWCKYVF-{Amide} | [Ile5;Phe6;Pra13;Leu26;Glu28]GpTx-1(1-34) | 1342 |
| DCLGGLRKCIPD[Pra]DKCCRPNLVCSRLHEWCKYVF-{Amide} | [Gly5;Leu6,26;Pra13;Glu28]GpTx-1(1-34) | 1343 |
| DCLGALRKCIPD[Pra]DKCCRPNLVCSRLHEWCKYVF-{Amide} | [Ala5;Leu6,26;Pra13;Glu28]GpTx-1(1-34) | 1344 |
| DCLG[2-Abu]LRKCIPD[Pra]DKCCRPNLVCSRLHEWCKYVF-{Amide} | [2-Abu5;Leu6,26;Pra13;Glu28]GpTx-1(1-34) | 1345 |
| DCLG[Nva]LRKCIPD[Pra]DKCCRPNLVCSRLHEWCKYVF-{Amide} | [Nva5;Leu6,26;Pra13;Glu28]GpTx-1(1-34) | 1346 |
| DCLG[Nle]LRKCIPD[Pra]DKCCRPNLVCSRLHEWCKYVF-{Amide} | [Nle5;Leu6,26;Pra13;Glu28]GpTx-1(1-34) | 1347 |
| DCLGVLRKCIPD[Pra]DKCCRPNLVCSRLHEWCKYVF-{Amide} | [Val5;Leu6,26;Pra13;Glu28]GpTx-1(1-34) | 1348 |
| DCLGLLRKCIPD[Pra]DKCCRPNLVCSRLHEWCKYVF-{Amide} | [Leu5,6,26;Pra13;Glu28]GpTx-1(1-34) | 1349 |
| DCLGILRKCIPD[Pra]DKCCRPNLVCSRLHEWCKYVF-{Amide} | [Ile5;Leu6,26;Pra13;Glu28]GpTx-1(1-34) | 1350 |
| DCLGG[Nle]RKCIPD[Pra]DKCCRPNLVCSRLHEWCKYVF-{Amide} | [Gly5;Nle6;Pra13;Leu26;Glu28]GpTx-1(1-34) | 1351 |
| DCLGA[Nle]RKCIPD[Pra]DKCCRPNLVCSRLHEWCKYVF-{Amide} | [Ala5;Nle6;Pra13;Leu26;Glu28]GpTx-1(1-34) | 1352 |
| DCLG[2-Abu][Nle]RKCIPD[Pra]DKCCRPNLVCSRLHEWCKYVF-{Amide} | [2-Abu5;Nle6;Pra13;Leu26;Glu28]GpTx-1(1-34) | 1353 |
| DCLG[Nva][Nle]RKCIPD[Pra]DKCCRPNLVCSRLHEWCKYVF-{Amide} | [Nva5;Nle6;Pra13;Leu26;Glu28]GpTx-1(1-34) | 1354 |
| DCLG[Nle][Nle]RKCIPD[Pra]DKCCRPNLVCSRLHEWCKYVF-{Amide} | [Nle5,6;Pra13;Leu26;Glu28]GpTx-1(1-34) | 1355 |
| DCLGV[Nle]RKCIPD[Pra]DKCCRPNLVCSRLHEWCKYVF-{Amide} | [Val5;Nle6;Pra13;Leu26;Glu28]GpTx-1(1-34) | 1356 |
| DCLGL[Nle]RKCIPD[Pra]DKCCRPNLVCSRLHEWCKYVF-{Amide} | [Leu5,26;Nle6;Pra13;Glu28]GpTx-1(1-34) | 1357 |
| DCLGI[Nle]RKCIPD[Pra]DKCCRPNLVCSRLHEWCKYVF-{Amide} | [Ile5;Nle6;Pra13;Leu26;Glu28]GpTx-1(1-34) | 1358 |
| DCLGGFRKCIED[2-Abu]DKCCRPNLVCSRTHEWCKYVF-{Amide} | [Gly5;Phe6;Glu11,28;2-Abu13]GpTx-1(1-34) | 1359 |
| DCLGAFRKCIED[2-Abu]DKCCRPNLVCSRTHEWCKYVF-{Amide} | [Ala5;Phe6;Glu11,28;2-Abu13]GpTx-1(1-34) | 1360 |
| DCLG[2-Abu]FRKCIED[2-Abu]DKCCRPNLVCSRTHEWCKYVF-{Amide} | [2-Abu5,13;Phe6;Glu11,28]GpTx-1(1-34) | 1361 |
| DCLG[Nva]FRKCIED[2-Abu]DKCCRPNLVCSRTHEWCKYVF-{Amide} | [Nva5;Phe6;Glu11,28;2-Abu13]GpTx-1(1-34) | 1362 |
| DCLG[Nle]FRKCIED[2-Abu]DKCCRPNLVCSRTHEWCKYVF-{Amide} | [Nle5;Phe6;Glu11,28;2-Abu13]GpTx-1(1-34) | 1363 |
| DCLGVFRKCIED[2-Abu]DKCCRPNLVCSRTHEWCKYVF-{Amide} | [Val5;Phe6;Glu11,28;2-Abu13]GpTx-1(1-34) | 1364 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGLFRKCIED[2-Abu]DKCCRPNLVCSRTHEWCKYVF-{Amide} | [Leu5;Phe6;Glu11,28;2-Abu13]GpTx-1(1-34) | 1365 |
| DCLGIFRKCIED[2-Abu]DKCCRPNLVCSRTHEWCKYVF-{Amide} | [Ile5;Phe6;Glu11,28;2-Abu13]GpTx-1(1-34) | 1366 |
| DCLGGLRKCIED[2-Abu]DKCCRPNLVCSRTHEWCKYVF-{Amide} | [Gly5;Leu6;Glu11,28;2-Abu13]GpTx-1(1-34) | 1367 |
| DCLGALRKCIED[2-Abu]DKCCRPNLVCSRTHEWCKYVF-{Amide} | [Ala5;Leu6;Glu11,28;2-Abu13]GpTx-1(1-34) | 1368 |
| DCLG[2-Abu]LRKCIED[2-Abu]DKCCRPNLVCSRTHEWCKYVF-{Amide} | [2-Abu5,13;Leu6;Glu11,28]GpTx-1(1-34) | 1369 |
| DCLG[Nva]LRKCIED[2-Abu]DKCCRPNLVCSRTHEWCKYVF-{Amide} | [Nva5;Leu6;Glu11,28;2-Abu13]GpTx-1(1-34) | 1370 |
| DCLG[Nle]LRKCIED[2-Abu]DKCCRPNLVCSRTHEWCKYVF-{Amide} | [Nle5;Leu6;Glu11,28;2-Abu13]GpTx-1(1-34) | 1371 |
| DCLGVLRKCIED[2-Abu]DKCCRPNLVCSRTHEWCKYVF-{Amide} | [Val5;Leu6;Glu11,28;2-Abu13]GpTx-1(1-34) | 1372 |
| DCLGLLRKCIED[2-Abu]DKCCRPNLVCSRTHEWCKYVF-{Amide} | [Leu5,6;Glu11,28;2-Abu13]GpTx-1(1-34) | 1373 |
| DCLGILRKCIED[2-Abu]DKCCRPNLVCSRTHEWCKYVF-{Amide} | [Ile5;Leu6;Glu11,28;2-Abu13]GpTx-1(1-34) | 1374 |
| DCLGG[Nle]RKCIED[2-Abu]DKCCRPNLVCSRTHEWCKYVF-{Amide} | [Gly5;Nle6;Glu11,28;2-Abu13]GpTx-1(1-34) | 1375 |
| DCLGA[Nle]RKCIED[2-Abu]DKCCRPNLVCSRTHEWCKYVF-{Amide} | [Ala5;Nle6;Glu11,28;2-Abu13]GpTx-1(1-34) | 1376 |
| DCLG[2-Abu][Nle]RKCIED[2-Abu]DKCCRPNLVCSRTHEWCKYVF-{Amide} | [2-Abu5,13;Nle6;Glu11,28]GpTx-1(1-34) | 1377 |
| DCLG[Nva][Nle]RKCIED[2-Abu]DKCCRPNLVCSRTHEWCKYVF-{Amide} | [Nva5;Nle6;Glu11,28;2-Abu13]GpTx-1(1-34) | 1378 |
| DCLG[Nle][Nle]RKCIED[2-Abu]DKCCRPNLVCSRTHEWCKYVF-{Amide} | [Nle5,6;Glu11,28;2-Abu13]GpTx-1(1-34) | 1379 |
| DCLGV[Nle]RKCIED[2-Abu]DKCCRPNLVCSRTHEWCKYVF-{Amide} | [Val5;Nle6;Glu11,28;2-Abu13]GpTx-1(1-34) | 1380 |
| DCLGL[Nle]RKCIED[2-Abu]DKCCRPNLVCSRTHEWCKYVF-{Amide} | [Leu5;Nle6;Glu11,28;2-Abu13]GpTx-1(1-34) | 1381 |
| DCLGI[Nle]RKCIED[2-Abu]DKCCRPNLVCSRTHEWCKYVF-{Amide} | [Ile5;Nle6;Glu11,28;2-Abu13]GpTx-1(1-34) | 1382 |
| DCLGGFRKCEPD[2-Abu]DKCCRPNLVCSRTHEWCKYVF-{Amide} | [Gly5;Phe6;Glu10,28;2-Abu13]GpTx-1(1-34) | 1383 |
| DCLGAFRKCEPD[2-Abu]DKCCRPNLVCSRTHEWCKYVF-{Amide} | [Ala5;Phe6;Glu10,28;2-Abu13]GpTx-1(1-34) | 1384 |
| DCLG[2-Abu]FRKCEPD[2-Abu]DKCCRPNLVCSRTHEWCKYVF-{Amide} | [2-Abu5,13;Phe6;Glu10,28]GpTx-1(1-34) | 1385 |
| DCLG[Nva]FRKCEPD[2-Abu]DKCCRPNLVCSRTHEWCKYVF-{Amide} | [Nva5;Phe6;Glu10,28;2-Abu13]GpTx-1(1-34) | 1386 |
| DCLG[Nle]FRKCEPD[2-Abu]DKCCRPNLVCSRTHEWCKYVF-{Amide} | [Nle5;Phe6;Glu10,28;2-Abu13]GpTx-1(1-34) | 1387 |
| DCLGVFRKCEPD[2-Abu]DKCCRPNLVCSRTHEWCKYVF-{Amide} | [Val5;Phe6;Glu10,28;2-Abu13]GpTx-1(1-34) | 1388 |
| DCLGLFRKCEPD[2-Abu]DKCCRPNLVCSRTHEWCKYVF-{Amide} | [Leu5;Phe6;Glu10,28;2-Abu13]GpTx-1(1-34) | 1389 |
| DCLGIFRKCEPD[2-Abu]DKCCRPNLVCSRTHEWCKYVF-{Amide} | [Ile5;Phe6;Glu10,28;2-Abu13]GpTx-1(1-34) | 1390 |
| DCLGGLRKCEPD[2-Abu]DKCCRPNLVCSRTHEWCKYVF-{Amide} | [Gly5;Leu6;Glu10,28;2-Abu13]GpTx-1(1-34) | 1391 |
| DCLGALRKCEPD[2-Abu]DKCCRPNLVCSRTHEWCKYVF-{Amide} | [Ala5;Leu6;Glu10,28;2-Abu13]GpTx-1(1-34) | 1392 |
| DCLG[2-Abu]LRKCEPD[2-Abu]DKCCRPNLVCSRTHEWCKYVF-{Amide} | [2-Abu5,13;Leu6;Glu10,28]GpTx-1(1-34) | 1393 |
| DCLG[Nva]LRKCEPD[2-Abu]DKCCRPNLVCSRTHEWCKYVF-{Amide} | [Nva5;Leu6;Glu10,28;2-Abu13]GpTx-1(1-34) | 1394 |
| DCLG[Nle]LRKCEPD[2-Abu]DKCCRPNLVCSRTHEWCKYVF-{Amide} | [Nle5;Leu6;Glu10,28;2-Abu13]GpTx-1(1-34) | 1395 |
| DCLGVLRKCEPD[2-Abu]DKCCRPNLVCSRTHEWCKYVF-{Amide} | [Val5;Leu6;Glu10,28;2-Abu13]GpTx-1(1-34) | 1396 |
| DCLGLLRKCEPD[2-Abu]DKCCRPNLVCSRTHEWCKYVF-{Amide} | [Leu5,6;Glu10,28;2-Abu13]GpTx-1(1-34) | 1397 |
| DCLGILRKCEPD[2-Abu]DKCCRPNLVCSRTHEWCKYVF-{Amide} | [Ile5;Leu6;Glu10,28;2-Abu13]GpTx-1(1-34) | 1398 |
| DCLGG[Nle]RKCEPD[2-Abu]DKCCRPNLVCSRTHEWCKYVF-{Amide} | [Gly5;Nle6;Glu10,28;2-Abu13]GpTx-1(1-34) | 1399 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGA[Nle]RKCEPD[2-Abu]DKCCRPNLVCSRTHEWCKYVF-{Amide} | [Ala5;Nle6;Glu10,28;2-Abu13]GpTx-1(1-34) | 1400 |
| DCLG[2-Abu][Nle]RKCEPD[2-Abu]DKCCRPNLVCSRTHEWCKYVF-{Amide} | [2-Abu5,13;Nle6;Glu10,28]GpTx-1(1-34) | 1401 |
| DCLG[Nva][Nle]RKCEPD[2-Abu]DKCCRPNLVCSRTHEWCKYVF-{Amide} | [Nva5;Nle6;Glu10,28;2-Abu13]GpTx-1(1-34) | 1402 |
| DCLG[Nle][Nle]RKCEPD[2-Abu]DKCCRPNLVCSRTHEWCKYVF-{Amide} | [Nle5,6;Glu10,28;2-Abu13]GpTx-1(1-34) | 1403 |
| DCLGV[Nle]RKCEPD[2-Abu]DKCCRPNLVCSRTHEWCKYVF-{Amide} | [Val5;Nle6;Glu10,28;2-Abu13]GpTx-1(1-34) | 1404 |
| DCLGL[Nle]RKCEPD[2-Abu]DKCCRPNLVCSRTHEWCKYVF-{Amide} | [Leu5;Nle6;Glu10,28;2-Abu13]GpTx-1(1-34) | 1405 |
| DCLGI[Nle]RKCEPD[2-Abu]DKCCRPNLVCSRTHEWCKYVF-{Amide} | [Ile5;Nle6;Glu10,28;2-Abu13]GpTx-1(1-34) | 1406 |
| DCLGGFRKCDPD[2-Abu]DKCCRPNLVCSRTHEWCKYVF-{Amide} | [Gly5;Phe6;Asp10;2-Abu13;Glu28]GpTx-1(1-34) | 1407 |
| DCLGAFRKCDPD[2-Abu]DKCCRPNLVCSRTHEWCKYVF-{Amide} | [Ala5;Phe6;Asp10;2-Abu13;Glu28]GpTx-1(1-34) | 1408 |
| DCLG[2-Abu]FRKCDPD[2-Abu]DKCCRPNLVCSRTHEWCKYVF-{Amide} | [2-Abu5,13;Phe6;Asp10;Glu28]GpTx-1(1-34) | 1409 |
| DCLG[Nva]FRKCDPD[2-Abu]DKCCRPNLVCSRTHEWCKYVF-{Amide} | [Nva5;Phe6;Asp10;2-Abu13;Glu28]GpTx-1(1-34) | 1410 |
| DCLG[Nle]FRKCDPD[2-Abu]DKCCRPNLVCSRTHEWCKYVF-{Amide} | [Nle5;Phe6;Asp10;2-Abu13;Glu28]GpTx-1(1-34) | 1411 |
| DCLGVFRKCDPD[2-Abu]DKCCRPNLVCSRTHEWCKYVF-{Amide} | [Val5;Phe6;Asp10;2-Abu13;Glu28]GpTx-1(1-34) | 1412 |
| DCLGLFRKCDPD[2-Abu]DKCCRPNLVCSRTHEWCKYVF-{Amide} | [Leu5;Phe6;Asp10;2-Abu13;Glu28]GpTx-1(1-34) | 1413 |
| DCLGIFRKCDPD[2-Abu]DKCCRPNLVCSRTHEWCKYVF-{Amide} | [Ile5;Phe6;Asp10;2-Abu13;Glu28]GpTx-1(1-34) | 1414 |
| DCLGGLRKCDPD[2-Abu]DKCCRPNLVCSRTHEWCKYVF-{Amide} | [Gly5;Leu6;Asp10;2-Abu13;Glu28]GpTx-1(1-34) | 1415 |
| DCLGALRKCDPD[2-Abu]DKCCRPNLVCSRTHEWCKYVF-{Amide} | [Ala5;Leu6;Asp10;2-Abu13;Glu28]GpTx-1(1-34) | 1416 |
| DCLG[2-Abu]LRKCDPD[2-Abu]DKCCRPNLVCSRTHEWCKYVF-{Amide} | [2-Abu5,13;Leu6;Asp10;Glu28]GpTx-1(1-34) | 1417 |
| DCLG[Nva]LRKCDPD[2-Abu]DKCCRPNLVCSRTHEWCKYVF-{Amide} | [Nva5;Leu6;Asp10;2-Abu13;Glu28]GpTx-1(1-34) | 1418 |
| DCLG[Nle]LRKCDPD[2-Abu]DKCCRPNLVCSRTHEWCKYVF-{Amide} | [Nle5;Leu6;Asp10;2-Abu13;Glu28]GpTx-1(1-34) | 1419 |
| DCLGVLRKCDPD[2-Abu]DKCCRPNLVCSRTHEWCKYVF-{Amide} | [Val5;Leu6;Asp10;2-Abu13;Glu28]GpTx-1(1-34) | 1420 |
| DCLGLLRKCDPD[2-Abu]DKCCRPNLVCSRTHEWCKYVF-{Amide} | [Leu5,6;Asp10;2-Abu13;Glu28]GpTx-1(1-34) | 1421 |
| DCLGILRKCDPD[2-Abu]DKCCRPNLVCSRTHEWCKYVF-{Amide} | [Ile5;Leu6;Asp10;2-Abu13;Glu28]GpTx-1(1-34) | 1422 |
| DCLGG[Nle]RKCDPD[2-Abu]DKCCRPNLVCSRTHEWCKYVF-{Amide} | [Gly5;Nle6;Asp10;2-Abu13;Glu28]GpTx-1(1-34) | 1423 |
| DCLGA[Nle]RKCDPD[2-Abu]DKCCRPNLVCSRTHEWCKYVF-{Amide} | [Ala5;Nle6;Asp10;2-Abu13;Glu28]GpTx-1(1-34) | 1424 |
| DCLG[2-Abu][Nle]RKCDPD[2-Abu]DKCCRPNLVCSRTHEWCKYVF-{Amide} | [2-Abu5,13;Nle6;Asp10;Glu28]GpTx-1(1-34) | 1425 |
| DCLG[Nva][Nle]RKCDPD[2-Abu]DKCCRPNLVCSRTHEWCKYVF-{Amide} | [Nva5;Nle6;Asp10;2-Abu13;Glu28]GpTx-1(1-34) | 1426 |
| DCLG[Nle][Nle]RKCDPD[2-Abu]DKCCRPNLVCSRTHEWCKYVF-{Amide} | [Nle5,6;Asp10;2-Abu13;Glu28]GpTx-1(1-34) | 1427 |
| DCLGV[Nle]RKCDPD[2-Abu]DKCCRPNLVCSRTHEWCKYVF-{Amide} | [Val5;Nle6;Asp10;2-Abu13;Glu28]GpTx-1(1-34) | 1428 |
| DCLGL[Nle]RKCDPD[2-Abu]DKCCRPNLVCSRTHEWCKYVF-{Amide} | [Leu5;Nle6;Asp10;2-Abu13;Glu28]GpTx-1(1-34) | 1429 |
| DCLGI[Nle]RKCDPD[2-Abu]DKCCRPNLVCSRTHEWCKYVF-{Amide} | [Ile5;Nle6;Asp10;2-Abu13;Glu28]GpTx-1(1-34) | 1430 |
| DCLGGFRKCIED[Pra]DKCCRPNLVCSRTHEWCKYVF-{Amide} | [Gly5;Phe6;Glu11,28;Pra13]GpTx-1(1-34) | 1431 |
| DCLGAFRKCIED[Pra]DKCCRPNLVCSRTHEWCKYVF-{Amide} | [Ala5;Phe6;Glu11,28;Pra13]GpTx-1(1-34) | 1432 |
| DCLG[2-Abu]FRKCIED[Pra]DKCCRPNLVCSRTHEWCKYVF-{Amide} | [2-Abu5;Phe6;Glu11,28;Pra13]GpTx-1(1-34) | 1433 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva]FRKCIED[Pra]DKCCRPNLVCSRTHEWCKYVF-{Amide} | [Nva5;Phe6;Glu11,28;Pra13]GpTx-1(1-34) | 1434 |
| DCLG[Nle]FRKCIED[Pra]DKCCRPNLVCSRTHEWCKYVF-{Amide} | [Nle5;Phe6;Glu11,28;Pra13]GpTx-1(1-34) | 1435 |
| DCLGVFRKCIED[Pra]DKCCRPNLVCSRTHEWCKYVF-{Amide} | [Val5;Phe6;Glu11,28;Pra13]GpTx-1(1-34) | 1436 |
| DCLGLFRKCIED[Pra]DKCCRPNLVCSRTHEWCKYVF-{Amide} | [Leu5;Phe6;Glu11,28;Pra13]GpTx-1(1-34) | 1437 |
| DCLGIFRKCIED[Pra]DKCCRPNLVCSRTHEWCKYVF-{Amide} | [Ile5;Phe6;Glu11,28;Pra13]GpTx-1(1-34) | 1438 |
| DCLGGLRKCIED[Pra]DKCCRPNLVCSRTHEWCKYVF-{Amide} | [Gly5;Leu6;Glu11,28;Pra13]GpTx-1(1-34) | 1439 |
| DCLGALRKCIED[Pra]DKCCRPNLVCSRTHEWCKYVF-{Amide} | [Ala5;Leu6;Glu11,28;Pra13]GpTx-1(1-34) | 1440 |
| DCLG[2-Abu]LRKCIED[Pra]DKCCRPNLVCSRTHEWCKYVF-{Amide} | [2-Abu5;Leu6;Glu11,28;Pra13]GpTx-1(1-34) | 1441 |
| DCLG[Nva]LRKCIED[Pra]DKCCRPNLVCSRTHEWCKYVF-{Amide} | [Nva5;Leu6;Glu11,28;Pra13]GpTx-1(1-34) | 1442 |
| DCLG[Nle]LRKCIED[Pra]DKCCRPNLVCSRTHEWCKYVF-{Amide} | [Nle5;Leu6;Glu11,28;Pra13]GpTx-1(1-34) | 1443 |
| DCLGVLRKCIED[Pra]DKCCRPNLVCSRTHEWCKYVF-{Amide} | [Val5;Leu6;Glu11,28;Pra13]GpTx-1(1-34) | 1444 |
| DCLGLLRKCIED[Pra]DKCCRPNLVCSRTHEWCKYVF-{Amide} | [Leu5,6;Glu11,28;Pra13]GpTx-1(1-34) | 1445 |
| DCLGILRKCIED[Pra]DKCCRPNLVCSRTHEWCKYVF-{Amide} | [Ile5;Leu6;Glu11,28;Pra13]GpTx-1(1-34) | 1446 |
| DCLGG[Nle]RKCIED[Pra]DKCCRPNLVCSRTHEWCKYVF-{Amide} | [Gly5;Nle6;Glu11,28;Pra13]GpTx-1(1-34) | 1447 |
| DCLGA[Nle]RKCIED[Pra]DKCCRPNLVCSRTHEWCKYVF-{Amide} | [Ala5;Nle6;Glu11,28;Pra13]GpTx-1(1-34) | 1448 |
| DCLG[2-Abu][Nle]RKCIED[Pra]DKCCRPNLVCSRTHEWCKYVF-{Amide} | [2-Abu5;Nle6;Glu11,28;Pra13]GpTx-1(1-34) | 1449 |
| DCLG[Nva][Nle]RKCIED[Pra]DKCCRPNLVCSRTHEWCKYVF-{Amide} | [Nva5;Nle6;Glu11,28;Pra13]GpTx-1(1-34) | 1450 |
| DCLG[Nle][Nle]RKCIED[Pra]DKCCRPNLVCSRTHEWCKYVF-{Amide} | [Nle5,6;Glu11,28;Pra13]GpTx-1(1-34) | 1451 |
| DCLGV[Nle]RKCIED[Pra]DKCCRPNLVCSRTHEWCKYVF-{Amide} | [Val5;Nle6;Glu11,28;Pra13]GpTx-1(1-34) | 1452 |
| DCLGL[Nle]RKCIED[Pra]DKCCRPNLVCSRTHEWCKYVF-{Amide} | [Leu5;Nle6;Glu11,28;Pra13]GpTx-1(1-34) | 1453 |
| DCLGI[Nle]RKCIED[Pra]DKCCRPNLVCSRTHEWCKYVF-{Amide} | [Ile5;Nle6;Glu11,28;Pra13]GpTx-1(1-34) | 1454 |
| DCLGGFRKCEPD[Pra]DKCCRPNLVCSRTHEWCKYVF-{Amide} | [Gly5;Phe6;Glu10,28;Pra13]GpTx-1(1-34) | 1455 |
| DCLGAFRKCEPD[Pra]DKCCRPNLVCSRTHEWCKYVF-{Amide} | [Ala5;Phe6;Glu10,28;Pra13]GpTx-1(1-34) | 1456 |
| DCLG[2-Abu]FRKCEPD[Pra]DKCCRPNLVCSRTHEWCKYVF-{Amide} | [2-Abu5;Phe6;Glu10,28;Pra13]GpTx-1(1-34) | 1457 |
| DCLG[Nva]FRKCEPD[Pra]DKCCRPNLVCSRTHEWCKYVF-{Amide} | [Nva5;Phe6;Glu10,28;Pra13]GpTx-1(1-34) | 1458 |
| DCLG[Nle]FRKCEPD[Pra]DKCCRPNLVCSRTHEWCKYVF-{Amide} | [Nle5;Phe6;Glu10,28;Pra13]GpTx-1(1-34) | 1459 |
| DCLGVFRKCEPD[Pra]DKCCRPNLVCSRTHEWCKYVF-{Amide} | [Val5;Phe6;Glu10,28;Pra13]GpTx-1(1-34) | 1460 |
| DCLGLFRKCEPD[Pra]DKCCRPNLVCSRTHEWCKYVF-{Amide} | [Leu5;Phe6;Glu10,28;Pra13]GpTx-1(1-34) | 1461 |
| DCLGIFRKCEPD[Pra]DKCCRPNLVCSRTHEWCKYVF-{Amide} | [Ile5;Phe6;Glu10,28;Pra13]GpTx-1(1-34) | 1462 |
| DCLGGLRKCEPD[Pra]DKCCRPNLVCSRTHEWCKYVF-{Amide} | [Gly5;Leu6;Glu10,28;Pra13]GpTx-1(1-34) | 1463 |
| DCLGALRKCEPD[Pra]DKCCRPNLVCSRTHEWCKYVF-{Amide} | [Ala5;Leu6;Glu10,28;Pra13]GpTx-1(1-34) | 1464 |
| DCLG[2-Abu]LRKCEPD[Pra]DKCCRPNLVCSRTHEWCKYVF-{Amide} | [2-Abu5;Leu6;Glu10,28;Pra13]GpTx-1(1-34) | 1465 |
| DCLG[Nva]LRKCEPD[Pra]DKCCRPNLVCSRTHEWCKYVF-{Amide} | [Nva5;Leu6;Glu10,28;Pra13]GpTx-1(1-34) | 1466 |
| DCLG[Nle]LRKCEPD[Pra]DKCCRPNLVCSRTHEWCKYVF-{Amide} | [Nle5;Leu6;Glu10,28;Pra13]GpTx-1(1-34) | 1467 |
| DCLGVLRKCEPD[Pra]DKCCRPNLVCSRTHEWCKYVF-{Amide} | [Val5;Leu6;Glu10,28;Pra13]GpTx-1(1-34) | 1468 |
| DCLGLLRKCEPD[Pra]DKCCRPNLVCSRTHEWCKYVF-{Amide} | [Leu5,6;Glu10,28;Pra13]GpTx-1(1-34) | 1469 |
| DCLGILRKCEPD[Pra]DKCCRPNLVCSRTHEWCKYVF-{Amide} | [Ile5;Leu6;Glu10,28;Pra13]GpTx-1(1-34) | 1470 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGG[Nle]RKCEPD[Pra]DKCCRPNLVCSRTHEWCKYVF-{Amide} | [Gly5;Nle6;Glu10,28;Pra13]GpTx-1(1-34) | 1471 |
| DCLGA[Nle]RKCEPD[Pra]DKCCRPNLVCSRTHEWCKYVF-{Amide} | [Ala5;Nle6;Glu10,28;Pra13]GpTx-1(1-34) | 1472 |
| DCLG[2-Abu][Nle]RKCEPD[Pra]DKCCRPNLVCSRTHEWCKYVF-{Amide} | [2-Abu5;Nle6;Glu10,28;Pra13]GpTx-1(1-34) | 1473 |
| DCLG[Nva][Nle]RKCEPD[Pra]DKCCRPNLVCSRTHEWCKYVF-{Amide} | [Nva5;Nle6;Glu10,28;Pra13]GpTx-1(1-34) | 1474 |
| DCLG[Nle][Nle]RKCEPD[Pra]DKCCRPNLVCSRTHEWCKYVF-{Amide} | [Nle5,6;Glu10,28;Pra13]GpTx-1(1-34) | 1475 |
| DCLGV[Nle]RKCEPD[Pra]DKCCRPNLVCSRTHEWCKYVF-{Amide} | [Val5;Nle6;Glu10,28;Pra13]GpTx-1(1-34) | 1476 |
| DCLGL[Nle]RKCEPD[Pra]DKCCRPNLVCSRTHEWCKYVF-{Amide} | [Leu5;Nle6;Glu10,28;Pra13]GpTx-1(1-34) | 1477 |
| DCLGI[Nle]RKCEPD[Pra]DKCCRPNLVCSRTHEWCKYVF-{Amide} | [Ile5;Nle6;Glu10,28;Pra13]GpTx-1(1-34) | 1478 |
| DCLGGFRKCDPD[Pra]DKCCRPNLVCSRTHEWCKYVF-{Amide} | [Gly5;Phe6;Asp10;Pra13;Glu28]GpTx-1(1-34) | 1479 |
| DCLGAFRKCDPD[Pra]DKCCRPNLVCSRTHEWCKYVF-{Amide} | [Ala5;Phe6;Asp10;Pra13;Glu28]GpTx-1(1-34) | 1480 |
| DCLG[2-Abu]FRKCDPD[Pra]DKCCRPNLVCSRTHEWCKYVF-{Amide} | [2-Abu5;Phe6;Asp10;Pra13;Glu28]GpTx-1(1-34) | 1481 |
| DCLG[Nva]FRKCDPD[Pra]DKCCRPNLVCSRTHEWCKYVF-{Amide} | [Nva5;Phe6;Asp10;Pra13;Glu28]GpTx-1(1-34) | 1482 |
| DCLG[Nle]FRKCDPD[Pra]DKCCRPNLVCSRTHEWCKYVF-{Amide} | [Nle5;Phe6;Asp10;Pra13;Glu28]GpTx-1(1-34) | 1483 |
| DCLGVFRKCDPD[Pra]DKCCRPNLVCSRTHEWCKYVF-{Amide} | [Val5;Phe6;Asp10;Pra13;Glu28]GpTx-1(1-34) | 1484 |
| DCLGLFRKCDPD[Pra]DKCCRPNLVCSRTHEWCKYVF-{Amide} | [Leu5;Phe6;Asp10;Pra13;Glu28]GpTx-1(1-34) | 1485 |
| DCLGIFRKCDPD[Pra]DKCCRPNLVCSRTHEWCKYVF-{Amide} | [Ile5;Phe6;Asp10;Pra13;Glu28]GpTx-1(1-34) | 1486 |
| DCLGGLRKCDPD[Pra]DKCCRPNLVCSRTHEWCKYVF-{Amide} | [Gly5;Leu6;Asp10;Pra13;Glu28]GpTx-1(1-34) | 1487 |
| DCLGALRKCDPD[Pra]DKCCRPNLVCSRTHEWCKYVF-{Amide} | [Ala5;Leu6;Asp10;Pra13;Glu28]GpTx-1(1-34) | 1488 |
| DCLG[2-Abu]LRKCDPD[Pra]DKCCRPNLVCSRTHEWCKYVF-{Amide} | [2-Abu5;Leu6;Asp10;Pra13;Glu28]GpTx-1(1-34) | 1489 |
| DCLG[Nva]LRKCDPD[Pra]DKCCRPNLVCSRTHEWCKYVF-{Amide} | [Nva5;Leu6;Asp10;Pra13;Glu28]GpTx-1(1-34) | 1490 |
| DCLG[Nle]LRKCDPD[Pra]DKCCRPNLVCSRTHEWCKYVF-{Amide} | [Nle5;Leu6;Asp10;Pra13;Glu28]GpTx-1(1-34) | 1491 |
| DCLGVLRKCDPD[Pra]DKCCRPNLVCSRTHEWCKYVF-{Amide} | [Val5;Leu6;Asp10;Pra13;Glu28]GpTx-1(1-34) | 1492 |
| DCLGLLRKCDPD[Pra]DKCCRPNLVCSRTHEWCKYVF-{Amide} | [Leu5,6;Asp10;Pra13;Glu28]GpTx-1(1-34) | 1493 |
| DCLGILRKCDPD[Pra]DKCCRPNLVCSRTHEWCKYVF-{Amide} | [Ile5;Leu6;Asp10;Pra13;Glu28]GpTx-1(1-34) | 1494 |
| DCLGG[Nle]RKCDPD[Pra]DKCCRPNLVCSRTHEWCKYVF-{Amide} | [Gly5;Nle6;Asp10;Pra13;Glu28]GpTx-1(1-34) | 1495 |
| DCLGA[Nle]RKCDPD[Pra]DKCCRPNLVCSRTHEWCKYVF-{Amide} | [Ala5;Nle6;Asp10;Pra13;Glu28]GpTx-1(1-34) | 1496 |
| DCLG[2-Abu][Nle]RKCDPD[Pra]DKCCRPNLVCSRTHEWCKYVF-{Amide} | [2-Abu5;Nle6;Asp10;Pra13;Glu28]GpTx-1(1-34) | 1497 |
| DCLG[Nva][Nle]RKCDPD[Pra]DKCCRPNLVCSRTHEWCKYVF-{Amide} | [Nva5;Nle6;Asp10;Pra13;Glu28]GpTx-1(1-34) | 1498 |
| DCLG[Nle][Nle]RKCDPD[Pra]DKCCRPNLVCSRTHEWCKYVF-{Amide} | [Nle5,6;Asp10;Pra13;Glu28]GpTx-1(1-34) | 1499 |
| DCLGV[Nle]RKCDPD[Pra]DKCCRPNLVCSRTHEWCKYVF-{Amide} | [Val5;Nle6;Asp10;Pra13;Glu28]GpTx-1(1-34) | 1500 |
| DCLGL[Nle]RKCDPD[Pra]DKCCRPNLVCSRTHEWCKYVF-{Amide} | [Leu5;Nle6;Asp10;Pra13;Glu28]GpTx-1(1-34) | 1501 |
| DCLGI[Nle]RKCDPD[Pra]DKCCRPNLVCSRTHEWCKYVF-{Amide} | [Ile5;Nle6;Asp10;Pra13;Glu28]GpTx-1(1-34) | 1502 |
| DCLGGFRKCIED[2-Abu]DKCCRPNLVCSRLHEWCKYVF-{Amide} | [Gly5;Phe6;Glu11,28;2-Abu13;Leu26]GpTx-1(1-34) | 1503 |
| DCLGAFRKCIED[2-Abu]DKCCRPNLVCSRLHEWCKYVF-{Amide} | [Ala5;Phe6;Glu11,28;2-Abu13;Leu26]GpTx-1(1-34) | 1504 |
| DCLG[2-Abu]FRKCIED[2-Abu]DKCCRPNLVCSRLHEWCKYVF-{Amide} | [2-Abu5,13;Phe6;Glu11,28;Leu26]GpTx-1(1-34) | 1505 |

TABLE 5B-continued

| Amino acid sequences of GpTx-1 and GpTx-1 peptide analogs. -{Amide} = amidated C-terminal. | | |
|---|---|---|
| Amino Acid Sequence | Designation | SEQ ID NO. |
| DCLG[Nva]FRKCIED[2-Abu]DKCCRPNLVCSRLHEWCKYVF-{Amide} | [Nva5;Phe6;Glu11,28;2-Abu13;Leu26]GpTx-1(1-34) | 1506 |
| DCLG[Nle]FRKCIED[2-Abu]DKCCRPNLVCSRLHEWCKYVF-{Amide} 1(1-34) | [Nle5;Phe6;Glu11,28;2-Abu13;Leu26]GpTx- | 1507 |
| DCLGVFRKCIED[2-Abu]DKCCRPNLVCSRLHEWCKYVF-{Amide} 1(1-34) | [Val5;Phe6;Glu11,28;2-Abu13;Leu26]GpTx- | 1508 |
| DCLGLFRKCIED[2-Abu]DKCCRPNLVCSRLHEWCKYVF-{Amide} | [Leu5,26;Phe6;Glu11,28;2-Abu13]GpTx-1(1-34) | 1509 |
| DCLGIFRKCIED[2-Abu]DKCCRPNLVCSRLHEWCKYVF-{Amide} 1(1-34) | [Ile5;Phe6;Glu11,28;2-Abu13;Leu26]GpTx- | 1510 |
| DCLGGLRKCIED[2-Abu]DKCCRPNLVCSRLHEWCKYVF-{Amide} | [Gly5;Leu6,26;Glu11,28;2-Abu13]GpTx-1(1-34) | 1511 |
| DCLGALRKCIED[2-Abu]DKCCRPNLVCSRLHEWCKYVF-{Amide} | [Ala5;Leu6,26;Glu11,28;2-Abu13]GpTx-1(1-34) | 1512 |
| DCLG[2-Abu]LRKCIED[2-Abu]DKCCRPNLVCSRLHEWCKYVF-{Amide} | [2-Abu5,13;Leu6,26;Glu11,28]GpTx-1(1-34) | 1513 |
| DCLG[Nva]LRKCIED[2-Abu]DKCCRPNLVCSRLHEWCKYVF-{Amide} | [Nva5;Leu6,26;Glu11,28;2-Abu13]GpTx-1(1-34) | 1514 |
| DCLG[Nle]LRKCIED[2-Abu]DKCCRPNLVCSRLHEWCKYVF-{Amide} | [Nle5;Leu6,26;Glu11,28;2-Abu13]GpTx-1(1-34) | 1515 |
| DCLGVLRKCIED[2-Abu]DKCCRPNLVCSRLHEWCKYVF-{Amide} | [Val5;Leu6,26;Glu11,28;2-Abu13]GpTx-1(1-34) | 1516 |
| DCLGLLRKCIED[2-Abu]DKCCRPNLVCSRLHEWCKYVF-{Amide} | [Leu5,6,26;Glu11,28;2-Abu13]GpTx-1(1-34) | 1517 |
| DCLGILRKCIED[2-Abu]DKCCRPNLVCSRLHEWCKYVF-{Amide} | [Ile5;Leu6,26;Glu11,28;2-Abu13]GpTx-1(1-34) | 1518 |
| DCLGG[Nle]RKCIED[2-Abu]DKCCRPNLVCSRLHEWCKYVF-{Amide} | [Gly5;Nle6;Glu11,28;2-Abu13;Leu26]GpTx-1(1-34) | 1519 |
| DCLGA[Nle]RKCIED[2-Abu]DKCCRPNLVCSRLHEWCKYVF-{Amide} | [Ala5;Nle6;Glu11,28;2-Abu13;Leu26]GpTx-1(1-34) | 1520 |
| DCLG[2-Abu][Nle]RKCIED[2-Abu]DKCCRPNLVCSRLHEWCKYVF-{Amide} | [2-Abu5,13;Nle6;Glu11,28;Leu26]GpTx-1(1-34) | 1521 |
| DCLG[Nva][Nle]RKCIED[2-Abu]DKCCRPNLVCSRLHEWCKYVF-{Amide} | [Nva5;Nle6;Glu11,28;2-Abu13;Leu26]GpTx-1(1-34) | 1522 |
| DCLG[Nle][Nle]RKCIED[2-Abu]DKCCRPNLVCSRLHEWCKYVF-{Amide} | [Nle5,6;Glu11,28;2-Abu13;Leu26]GpTx-1(1-34) | 1523 |
| DCLGV[Nle]RKCIED[2-Abu]DKCCRPNLVCSRLHEWCKYVF-{Amide} | [Val5;Nle6;Glu11,28;2-Abu13;Leu26]GpTx-1(1-34) | 1524 |
| DCLGL[Nle]RKCIED[2-Abu]DKCCRPNLVCSRLHEWCKYVF-{Amide} | [Leu5,26;Nle6;Glu11,28;2-Abu13]GpTx-1(1-34) | 1525 |
| DCLGI[Nle]RKCIED[2-Abu]DKCCRPNLVCSRLHEWCKYVF-{Amide} | [Ile5;Nle6;Glu11,28;2-Abu13;Leu26]GpTx-1(1-34) | 1526 |
| DCLGGFRKCEPD[2-Abu]DKCCRPNLVCSRLHEWCKYVF-{Amide} | [Gly5;Phe6;Glu10,28;2-Abu13;Leu26]GpTx-1(1-34) | 1527 |
| DCLGAFRKCEPD[2-Abu]DKCCRPNLVCSRLHEWCKYVF-{Amide} | [Ala5;Phe6;Glu10,28;2-Abu13;Leu26]GpTx-1(1-34) | 1528 |
| DCLG[2-Abu]FRKCEPD[2-Abu]DKCCRPNLVCSRLHEWCKYVF-{Amide} | [2-Abu5,13;Phe6;Glu10,28;Leu26]GpTx-1(1-34) | 1529 |
| DCLG[Nva]FRKCEPD[2-Abu]DKCCRPNLVCSRLHEWCKYVF-{Amide} | [Nva5;Phe6;Glu10,28;2-Abu13;Leu26]GpTx-1(1-34) | 1530 |
| DCLG[Nle]FRKCEPD[2-Abu]DKCCRPNLVCSRLHEWCKYVF-{Amide} | [Nle5;Phe6;Glu10,28;2-Abu13;Leu26]GpTx-1(1-34) | 1531 |
| DCLGVFRKCEPD[2-Abu]DKCCRPNLVCSRLHEWCKYVF-{Amide} | [Val5;Phe6;Glu10,28;2-Abu13;Leu26]GpTx-1(1-34) | 1532 |
| DCLGLFRKCEPD[2-Abu]DKCCRPNLVCSRLHEWCKYVF-{Amide} | [Leu5,26;Phe6;Glu10,28;2-Abu13]GpTx-1(1-34) | 1533 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGIFRKCEPD[2-Abu]DKCCRPNLVCSRLHEWCKYVF-{Amide} | [Ile5;Phe6;Glu10,28;2-Abu13;Leu26]GpTx-1(1-34) | 1534 |
| DCLGGLRKCEPD[2-Abu]DKCCRPNLVCSRLHEWCKYVF-{Amide} | [Gly5;Leu6,26;Glu10,28;2-Abu13]GpTx-1(1-34) | 1535 |
| DCLGALRKCEPD[2-Abu]DKCCRPNLVCSRLHEWCKYVF-{Amide} | [Ala5;Leu6,26;Glu10,28;2-Abu13]GpTx-1(1-34) | 1536 |
| DCLG[2-Abu]LRKCEPD[2-Abu]DKCCRPNLVCSRLHEWCKYVF-{Amide} | [2-Abu5,13;Leu6,26;Glu10,28]GpTx-1(1-34) | 1537 |
| DCLG[Nva]LRKCEPD[2-Abu]DKCCRPNLVCSRLHEWCKYVF-{Amide} | [Nva5;Leu6,26;Glu10,28;2-Abu13]GpTx-1(1-34) | 1538 |
| DCLG[Nle]LRKCEPD[2-Abu]DKCCRPNLVCSRLHEWCKYVF-{Amide} | [Nle5;Leu6,26;Glu10,28;2-Abu13]GpTx-1(1-34) | 1539 |
| DCLGVLRKCEPD[2-Abu]DKCCRPNLVCSRLHEWCKYVF-{Amide} | [Val5;Leu6,26;Glu10,28;2-Abu13]GpTx-1(1-34) | 1540 |
| DCLGLLRKCEPD[2-Abu]DKCCRPNLVCSRLHEWCKYVF-{Amide} | [Leu5,6,26;Glu10,28;2-Abu13]GpTx-1(1-34) | 1541 |
| DCLGILRKCEPD[2-Abu]DKCCRPNLVCSRLHEWCKYVF-{Amide} | [Ile5;Leu6,26;Glu10,28;2-Abu13]GpTx-1(1-34) | 1542 |
| DCLGG[Nle]RKCEPD[2-Abu]DKCCRPNLVCSRLHEWCKYVF-{Amide} | [Gly5;Nle6;Glu10,28;2-Abu13;Leu26]GpTx-1(1-34) | 1543 |
| DCLGA[Nle]RKCEPD[2-Abu]DKCCRPNLVCSRLHEWCKYVF-{Amide} | [Ala5;Nle6;Glu10,28;2-Abu13;Leu26]GpTx-1(1-34) | 1544 |
| DCLG[2-Abu][Nle]RKCEPD[2-Abu]DKCCRPNLVCSRLHEWCKYVF-{Amide} | [2-Abu5,13;Nle6;Glu10,28;Leu26]GpTx-1(1-34) | 1545 |
| DCLG[Nva][Nle]RKCEPD[2-Abu]DKCCRPNLVCSRLHEWCKYVF-{Amide} | [Nva5;Nle6;Glu10,28;2-Abu13;Leu26]GpTx-1(1-34) | 1546 |
| DCLG[Nle][Nle]RKCEPD[2-Abu]DKCCRPNLVCSRLHEWCKYVF-{Amide} | [Nle5,6;Glu10,28;2-Abu13;Leu26]GpTx-1(1-34) | 1547 |
| DCLGV[Nle]RKCEPD[2-Abu]DKCCRPNLVCSRLHEWCKYVF-{Amide} | [Val5;Nle6;Glu10,28;2-Abu13;Leu26]GpTx-1(1-34) | 1548 |
| DCLGL[Nle]RKCEPD[2-Abu]DKCCRPNLVCSRLHEWCKYVF-{Amide} | [Leu5,26;Nle6;Glu10,28;2-Abu13]GpTx-1(1-34) | 1549 |
| DCLGI[Nle]RKCEPD[2-Abu]DKCCRPNLVCSRLHEWCKYVF-{Amide} | [Ile5;Nle6;Glu10,28;2-Abu13;Leu26]GpTx-1(1-34) | 1550 |
| DCLGGFRKCDPD[2-Abu]DKCCRPNLVCSRLHEWCKYVF-{Amide} | [Gly5;Phe6;Asp10;2-Abu13;Leu26;Glu28]GpTx-1(1-34) | 1551 |
| DCLGAFRKCDPD[2-Abu]DKCCRPNLVCSRLHEWCKYVF-{Amide} | [Ala5;Phe6;Asp10;2-Abu13;Leu26;Glu28]GpTx-1(1-34) | 1552 |
| DCLG[2-Abu]FRKCDPD[2-Abu]DKCCRPNLVCSRLHEWCKYVF-{Amide} | [2-Abu5,13;Phe6;Asp10;Leu26;Glu28]GpTx-1(1-34) | 1553 |
| DCLG[Nva]FRKCDPD[2-Abu]DKCCRPNLVCSRLHEWCKYVF-{Amide} | [Nva5;Phe6;Asp10;2-Abu13;Leu26;Glu28]GpTx-1(1-34) | 1554 |
| DCLG[Nle]FRKCDPD[2-Abu]DKCCRPNLVCSRLHEWCKYVF-{Amide} | [Nle5;Phe6;Asp10;2-Abu13;Leu26;Glu28]GpTx-1(1-34) | 1555 |
| DCLGVFRKCDPD[2-Abu]DKCCRPNLVCSRLHEWCKYVF-{Amide} | [Val5;Phe6;Asp10;2-Abu13;Leu26;Glu28]GpTx-1(1-34) | 1556 |
| DCLGLFRKCDPD[2-Abu]DKCCRPNLVCSRLHEWCKYVF-{Amide} | [Leu5,26;Phe6;Asp10;2-Abu13;Glu28]GpTx-1(1-34) | 1557 |
| DCLGIFRKCDPD[2-Abu]DKCCRPNLVCSRLHEWCKYVF-{Amide} | [Ile5;Phe6;Asp10;2-Abu13;Leu26;Glu28]GpTx-1(1-34) | 1558 |
| DCLGGLRKCDPD[2-Abu]DKCCRPNLVCSRLHEWCKYVF-{Amide} | [Gly5;Leu6,26;Asp10;2-Abu13;Glu28]GpTx-1(1-34) | 1559 |
| DCLGALRKCDPD[2-Abu]DKCCRPNLVCSRLHEWCKYVF-{Amide} | [Ala5;Leu6,26;Asp10;2-Abu13;Glu28]GpTx-1(1-34) | 1560 |
| DCLG[2-Abu]LRKCDPD[2-Abu]DKCCRPNLVCSRLHEWCKYVF-{Amide} | [2-Abu5,13;Leu6,26;Asp10;Glu28]GpTx-1(1-34) | 1561 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva]LRKCDPD[2-Abu]DKCCRPNLVCSRLHEWCKYVF-{Amide} | [Nva5;Leu6,26;Asp10;2-Abu13;Glu28]GpTx-1(1-34) | 1562 |
| DCLG[Nle]LRKCDPD[2-Abu]DKCCRPNLVCSRLHEWCKYVF-{Amide} | [Nle5;Leu6,26;Asp10;2-Abu13;Glu28]GpTx-1(1-34) | 1563 |
| DCLGVLRKCDPD[2-Abu]DKCCRPNLVCSRLHEWCKYVF-{Amide} | [Val5;Leu6,26;Asp10;2-Abu13;Glu28]GpTx-1(1-34) | 1564 |
| DCLGLLRKCDPD[2-Abu]DKCCRPNLVCSRLHEWCKYVF-{Amide} | [Leu5,6,26;Asp10;2-Abu13;Glu28]GpTx-1(1-34) | 1565 |
| DCLGILRKCDPD[2-Abu]DKCCRPNLVCSRLHEWCKYVF-{Amide} | [Ile5;Leu6,26;Asp10;2-Abu13;Glu28]GpTx-1(1-34) | 1566 |
| DCLGG[Nle]RKCDPD[2-Abu]DKCCRPNLVCSRLHEWCKYVF-{Amide} | [Gly5;Nle6;Asp10;2-Abu13;Leu26;Glu28]GpTx-1(1-34) | 1567 |
| DCLGA[Nle]RKCDPD[2-Abu]DKCCRPNLVCSRLHEWCKYVF-{Amide} | [Ala5;Nle6;Asp10;2-Abu13;Leu26;Glu28]GpTx-1(1-34) | 1568 |
| DCLG[2-Abu][Nle]RKCDPD[2-Abu]DKCCRPNLVCSRLHEWCKYVF-{Amide} | [2-Abu5,13;Nle6;Asp10;Leu26;Glu28]GpTx-1(1-34) | 1569 |
| DCLG[Nva][Nle]RKCDPD[2-Abu]DKCCRPNLVCSRLHEWCKYVF-{Amide} | [Nva5;Nle6;Asp10;2-Abu13;Leu26;Glu28]GpTx-1(1-34) | 1570 |
| DCLG[Nle][Nle]RKCDPD[2-Abu]DKCCRPNLVCSRLHEWCKYVF-{Amide} | [Nle5,6;Asp10;2-Abu13;Leu26;Glu28]GpTx-1(1-34) | 1571 |
| DCLGV[Nle]RKCDPD[2-Abu]DKCCRPNLVCSRLHEWCKYVF-{Amide} | [Val5;Nle6;Asp10;2-Abu13;Leu26;Glu28]GpTx-1(1-34) | 1572 |
| DCLGL[Nle]RKCDPD[2-Abu]DKCCRPNLVCSRLHEWCKYVF-{Amide} | [Leu5,26;Nle6;Asp10;2-Abu13;Glu28]GpTx-1(1-34) | 1573 |
| DCLGI[Nle]RKCDPD[2-Abu]DKCCRPNLVCSRLHEWCKYVF-{Amide} | [Ile5;Nle6;Asp10;2-Abu13;Leu26;Glu28]GpTx-1(1-34) | 1574 |
| DCLGGFRKCIED[Pra]DKCCRPNLVCSRLHEWCKYVF-{Amide} | [Gly5;Phe6;Glu11,28;Pra13;Leu26]GpTx-1(1-34) | 1575 |
| DCLGAFRKCIED[Pra]DKCCRPNLVCSRLHEWCKYVF-{Amide} | [Ala5;Phe6;Glu11,28;Pra13;Leu26]GpTx-1(1-34) | 1576 |
| DCLG[2-Abu]FRKCIED[Pra]DKCCRPNLVCSRLHEWCKYVF-{Amide} | [2-Abu5;Phe6;Glu11,28;Pra13;Leu26]GpTx-1(1-34) | 1577 |
| DCLG[Nva]FRKCIED[Pra]DKCCRPNLVCSRLHEWCKYVF-{Amide} | [Nva5;Phe6;Glu11,28;Pra13;Leu26]GpTx-1(1-34) | 1578 |
| DCLG[Nle]FRKCIED[Pra]DKCCRPNLVCSRLHEWCKYVF-{Amide} | [Nle5;Phe6;Glu11,28;Pra13;Leu26]GpTx-1(1-34) | 1579 |
| DCLGVFRKCIED[Pra]DKCCRPNLVCSRLHEWCKYVF-{Amide} | [Val5;Phe6;Glu11,28;Pra13;Leu26]GpTx-1(1-34) | 1580 |
| DCLGLFRKCIED[Pra]DKCCRPNLVCSRLHEWCKYVF-{Amide} | [Leu5,26;Phe6;Glu11,28;Pra13]GpTx-1(1-34) | 1581 |
| DCLGIFRKCIED[Pra]DKCCRPNLVCSRLHEWCKYVF-{Amide} | [Ile5;Phe6;Glu11,28;Pra13;Leu26]GpTx-1(1-34) | 1582 |
| DCLGGLRKCIED[Pra]DKCCRPNLVCSRLHEWCKYVF-{Amide} | [Gly5;Leu6,26;Glu11,28;Pra13]GpTx-1(1-34) | 1583 |
| DCLGALRKCIED[Pra]DKCCRPNLVCSRLHEWCKYVF-{Amide} | [Ala5;Leu6,26;Glu11,28;Pra13]GpTx-1(1-34) | 1584 |
| DCLG[2-Abu]LRKCIED[Pra]DKCCRPNLVCSRLHEWCKYVF-{Amide} | [2-Abu5;Leu6,26;Glu11,28;Pra13]GpTx-1(1-34) | 1585 |
| DCLG[Nva]LRKCIED[Pra]DKCCRPNLVCSRLHEWCKYVF-{Amide} | [Nva5;Leu6,26;Glu11,28;Pra13]GpTx-1(1-34) | 1586 |
| DCLG[Nle]LRKCIED[Pra]DKCCRPNLVCSRLHEWCKYVF-{Amide} | [Nle5;Leu6,26;Glu11,28;Pra13]GpTx-1(1-34) | 1587 |
| DCLGVLRKCIED[Pra]DKCCRPNLVCSRLHEWCKYVF-{Amide} | [Val5;Leu6,26;Glu11,28;Pra13]GpTx-1(1-34) | 1588 |
| DCLGLLRKCIED[Pra]DKCCRPNLVCSRLHEWCKYVF-{Amide} | [Leu5,6,26;Glu11,28;Pra13]GpTx-1(1-34) | 1589 |
| DCLGILRKCIED[Pra]DKCCRPNLVCSRLHEWCKYVF-{Amide} | [Ile5;Leu6,26;Glu11,28;Pra13]GpTx-1(1-34) | 1590 |
| DCLGG[Nle]RKCIED[Pra]DKCCRPNLVCSRLHEWCKYVF-{Amide} | [Gly5;Nle6;Glu11,28;Pra13;Leu26]GpTx-1(1-34) | 1591 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGA[Nle]RKCIED[Pra]DKCCRPNLVCSRLHEWCKYVF-{Amide} | [Ala5;Nle6;Glu11,28;Pra13;Leu26]GpTx-1(1-34) | 1592 |
| DCLG[2-Abu][Nle]RKCIED[Pra]DKCCRPNLVCSRLHEWCKYVF-{Amide} | [2-Abu5;Nle6;Glu11,28;Pra13;Leu26]GpTx-1(1-34) | 1593 |
| DCLG[Nva][Nle]RKCIED[Pra]DKCCRPNLVCSRLHEWCKYVF-{Amide} | [Nva5;Nle6;Glu11,28;Pra13;Leu26]GpTx-1(1-34) | 1594 |
| DCLG[Nle][Nle]RKCIED[Pra]DKCCRPNLVCSRLHEWCKYVF-{Amide} | [Nle5,6;Glu11,28;Pra13;Leu26]GpTx-1(1-34) | 1595 |
| DCLGV[Nle]RKCIED[Pra]DKCCRPNLVCSRLHEWCKYVF-{Amide} | [Val5;Nle6;Glu11,28;Pra13;Leu26]GpTx-1(1-34) | 1596 |
| DCLGL[Nle]RKCIED[Pra]DKCCRPNLVCSRLHEWCKYVF-{Amide} | [Leu5,26;Nle6;Glu11,28;Pra13]GpTx-1(1-34) | 1597 |
| DCLGI[Nle]RKCIED[Pra]DKCCRPNLVCSRLHEWCKYVF-{Amide} | [Ile5;Nle6;Glu11,28;Pra13;Leu26]GpTx-1(1-34) | 1598 |
| DCLGGFRKCEPD[Pra]DKCCRPNLVCSRLHEWCKYVF-{Amide} | [Gly5;Phe6;Glu10,28;Pra13;Leu26]GpTx-1(1-34) | 1599 |
| DCLGAFRKCEPD[Pra]DKCCRPNLVCSRLHEWCKYVF-{Amide} | [Ala5;Phe6;Glu10,28;Pra13;Leu26]GpTx-1(1-34) | 1600 |
| DCLG[2-Abu]FRKCEPD[Pra]DKCCRPNLVCSRLHEWCKYVF-{Amide} | [2-Abu5;Phe6;Glu10,28;Pra13;Leu26]GpTx-1(1-34) | 1601 |
| DCLG[Nva]FRKCEPD[Pra]DKCCRPNLVCSRLHEWCKYVF-{Amide} | [Nva5;Phe6;Glu10,28;Pra13;Leu26]GpTx-1(1-34) | 1602 |
| DCLG[Nle]FRKCEPD[Pra]DKCCRPNLVCSRLHEWCKYVF-{Amide} | [Nle5;Phe6;Glu10,28;Pra13;Leu26]GpTx-1(1-34) | 1603 |
| DCLGVFRKCEPD[Pra]DKCCRPNLVCSRLHEWCKYVF-{Amide} | [Val5;Phe6;Glu10,28;Pra13;Leu26]GpTx-1(1-34) | 1604 |
| DCLGLFRKCEPD[Pra]DKCCRPNLVCSRLHEWCKYVF-{Amide} | [Leu5,26;Phe6;Glu10,28;Pra13]GpTx-1(1-34) | 1605 |
| DCLGIFRKCEPD[Pra]DKCCRPNLVCSRLHEWCKYVF-{Amide} | [Ile5;Phe6;Glu10,28;Pra13;Leu26]GpTx-1(1-34) | 1606 |
| DCLGGLRKCEPD[Pra]DKCCRPNLVCSRLHEWCKYVF-{Amide} | [Gly5;Leu6,26;Glu10,28;Pra13]GpTx-1(1-34) | 1607 |
| DCLGALRKCEPD[Pra]DKCCRPNLVCSRLHEWCKYVF-{Amide} | [Ala5;Leu6,26;Glu10,28;Pra13]GpTx-1(1-34) | 1608 |
| DCLG[2-Abu]LRKCEPD[Pra]DKCCRPNLVCSRLHEWCKYVF-{Amide} | [2-Abu5;Leu6,26;Glu10,28;Pra13]GpTx-1(1-34) | 1609 |
| DCLG[Nva]LRKCEPD[Pra]DKCCRPNLVCSRLHEWCKYVF-{Amide} | [Nva5;Leu6,26;Glu10,28;Pra13]GpTx-1(1-34) | 1610 |
| DCLG[Nle]LRKCEPD[Pra]DKCCRPNLVCSRLHEWCKYVF-{Amide} | [Nle5;Leu6,26;Glu10,28;Pra13]GpTx-1(1-34) | 1611 |
| DCLGVLRKCEPD[Pra]DKCCRPNLVCSRLHEWCKYVF-{Amide} | [Val5;Leu6,26;Glu10,28;Pra13]GpTx-1(1-34) | 1612 |
| DCLGLLRKCEPD[Pra]DKCCRPNLVCSRLHEWCKYVF-{Amide} | [Leu5,6,26;Glu10,28;Pra13]GpTx-1(1-34) | 1613 |
| DCLGILRKCEPD[Pra]DKCCRPNLVCSRLHEWCKYVF-{Amide} | [Ile5;Leu6,26;Glu10,28;Pra13]GpTx-1(1-34) | 1614 |
| DCLGG[Nle]RKCEPD[Pra]DKCCRPNLVCSRLHEWCKYVF-{Amide} | [Gly5;Nle6;Glu10,28;Pra13;Leu26]GpTx-1(1-34) | 1615 |
| DCLGA[Nle]RKCEPD[Pra]DKCCRPNLVCSRLHEWCKYVF-{Amide} | [Ala5;Nle6;Glu10,28;Pra13;Leu26]GpTx-1(1-34) | 1616 |
| DCLG[2-Abu][Nle]RKCEPD[Pra]DKCCRPNLVCSRLHEWCKYVF-{Amide} | [2-Abu5;Nle6;Glu10,28;Pra13;Leu26]GpTx-1(1-34) | 1617 |
| DCLG[Nva][Nle]RKCEPD[Pra]DKCCRPNLVCSRLHEWCKYVF-{Amide} | [Nva5;Nle6;Glu10,28;Pra13;Leu26]GpTx-1(1-34) | 1618 |
| DCLG[Nle][Nle]RKCEPD[Pra]DKCCRPNLVCSRLHEWCKYVF-{Amide} | [Nle5,6;Glu10,28;Pra13;Leu26]GpTx-1(1-34) | 1619 |
| DCLGV[Nle]RKCEPD[Pra]DKCCRPNLVCSRLHEWCKYVF-{Amide} | [Val5;Nle6;Glu10,28;Pra13;Leu26]GpTx-1(1-34) | 1620 |
| DCLGL[Nle]RKCEPD[Pra]DKCCRPNLVCSRLHEWCKYVF-{Amide} | [Leu5,26;Nle6;Glu10,28;Pra13]GpTx-1(1-34) | 1621 |
| DCLGI[Nle]RKCEPD[Pra]DKCCRPNLVCSRLHEWCKYVF-{Amide} | [Ile5;Nle6;Glu10,28;Pra13;Leu26]GpTx-1(1-34) | 1622 |
| DCLGGFRKCDPD[Pra]DKCCRPNLVCSRLHEWCKYVF-{Amide} | [Gly5;Phe6;Asp10;Pra13;Leu26;Glu28]GpTx-1(1-34) | 1623 |
| DCLGAFRKCDPD[Pra]DKCCRPNLVCSRLHEWCKYVF-{Amide} | [Ala5;Phe6;Asp10;Pra13;Leu26;Glu28]GpTx-1(1-34) | 1624 |
| DCLG[2-Abu]FRKCDPD[Pra]DKCCRPNLVCSRLHEWCKYVF-{Amide} | [2-Abu5;Phe6;Asp10;Pra13;Leu26;Glu28]GpTx-1(1-34) | 1625 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva]FRKCDPD[Pra]DKCCRPNLVCSRLHEWCKYVF-{Amide} | [Nva5;Phe6;Asp10;Pra13;Leu26;Glu28]GpTx-1(1-34) | 1626 |
| DCLG[Nle]FRKCDPD[Pra]DKCCRPNLVCSRLHEWCKYVF-{Amide} | [Nle5;Phe6;Asp10;Pra13;Leu26;Glu28]GpTx-1(1-34) | 1627 |
| DCLGVFRKCDPD[Pra]DKCCRPNLVCSRLHEWCKYVF-{Amide} | [Val5;Phe6;Asp10;Pra13;Leu26;Glu28]GpTx-1(1-34) | 1628 |
| DCLGLFRKCDPD[Pra]DKCCRPNLVCSRLHEWCKYVF-{Amide} | [Leu5,26;Phe6;Asp10;Pra13;Glu28]GpTx-1(1-34) | 1629 |
| DCLGIFRKCDPD[Pra]DKCCRPNLVCSRLHEWCKYVF-{Amide} | [Ile5;Phe6;Asp10;Pra13;Leu26;Glu28]GpTx-1(1-34) | 1630 |
| DCLGGLRKCDPD[Pra]DKCCRPNLVCSRLHEWCKYVF-{Amide} | [Gly5;Leu6,26;Asp10;Pra13;Glu28]GpTx-1(1-34) | 1631 |
| DCLGALRKCDPD[Pra]DKCCRPNLVCSRLHEWCKYVF-{Amide} | [Ala5;Leu6,26;Asp10;Pra13;Glu28]GpTx-1(1-34) | 1632 |
| DCLG[2-Abu]LRKCDPD[Pra]DKCCRPNLVCSRLHEWCKYVF-{Amide} | [2-Abu5;Leu6,26;Asp10;Pra13;Glu28]GpTx-1(1-34) | 1633 |
| DCLG[Nva]LRKCDPD[Pra]DKCCRPNLVCSRLHEWCKYVF-{Amide} | [Nva5;Leu6,26;Asp10;Pra13;Glu28]GpTx-1(1-34) | 1634 |
| DCLG[Nle]LRKCDPD[Pra]DKCCRPNLVCSRLHEWCKYVF-{Amide} | [Nle5;Leu6,26;Asp10;Pra13;Glu28]GpTx-1(1-34) | 1635 |
| DCLGVLRKCDPD[Pra]DKCCRPNLVCSRLHEWCKYVF-{Amide} | [Val5;Leu6,26;Asp10;Pra13;Glu28]GpTx-1(1-34) | 1636 |
| DCLGLLRKCDPD[Pra]DKCCRPNLVCSRLHEWCKYVF-{Amide} | [Leu5,6,26;Asp10;Pra13;Glu28]GpTx-1(1-34) | 1637 |
| DCLGILRKCDPD[Pra]DKCCRPNLVCSRLHEWCKYVF-{Amide} | [Ile5;Leu6,26;Asp10;Pra13;Glu28]GpTx-1(1-34) | 1638 |
| DCLGG[Nle]RKCDPD[Pra]DKCCRPNLVCSRLHEWCKYVF-{Amide} | [Gly5;Nle6;Asp10;Pra13;Leu26;Glu28]GpTx-1(1-34) | 1639 |
| DCLGA[Nle]RKCDPD[Pra]DKCCRPNLVCSRLHEWCKYVF-{Amide} | [Ala5;Nle6;Asp10;Pra13;Leu26;Glu28]GpTx-1(1-34) | 1640 |
| DCLG[2-Abu][Nle]RKCDPD[Pra]DKCCRPNLVCSRLHEWCKYVF-{Amide} | [2-Abu5;Nle6;Asp10;Pra13;Leu26;Glu28]GpTx-1(1-34) | 1641 |
| DCLG[Nva][Nle]RKCDPD[Pra]DKCCRPNLVCSRLHEWCKYVF-{Amide} | [Nva5;Nle6;Asp10;Pra13;Leu26;Glu28]GpTx-1(1-34) | 1642 |
| DCLG[Nle][Nle]RKCDPD[Pra]DKCCRPNLVCSRLHEWCKYVF-{Amide} | [Nle5,6;Asp10;Pra13;Leu26;Glu28]GpTx-1(1-34) | 1643 |
| DCLGV[Nle]RKCDPD[Pra]DKCCRPNLVCSRLHEWCKYVF-{Amide} | [Val5;Nle6;Asp10;Pra13;Leu26;Glu28]GpTx-1(1-34) | 1644 |
| DCLGL[Nle]RKCDPD[Pra]DKCCRPNLVCSRLHEWCKYVF-{Amide} | [Leu5,26;Nle6;Asp10;Pra13;Glu28]GpTx-1(1-34) | 1645 |
| DCLGI[Nle]RKCDPD[Pra]DKCCRPNLVCSRLHEWCKYVF-{Amide} | [Ile5;Nle6;Asp10;Pra13;Leu26;Glu28]GpTx-1(1-34) | 1646 |
| DCLGFMRKCIPD[2-Abu]DKCCRPNLVCSRTHDWCKYVF-{Amide} | [2-Abu13;Asp28]GpTx-1(1-34) | 1647 |
| DCLGFMRKCIPD[Pra]DKCCRPNLVCSRTHDWCKYVF-{Amide} | [Pra13;Asp28]GpTx-1(1-34) | 1648 |
| DCLGFMRKCIPD[2-Abu]DKCCRPNLVCSRLHDWCKYVF-{Amide} | [2-Abu13;Leu26;Asp28]GpTx-1(1-34) | 1649 |
| DCLGFMRKCIPD[Pra]DKCCRPNLVCSRLHDWCKYVF-{Amide} | [Pra13;Leu26;Asp28]GpTx-1(1-34) | 1650 |
| DCLGFMRKCIED[2-Abu]DKCCRPNLVCSRTHDWCKYVF-{Amide} | [Glu11;2-Abu13;Asp28]GpTx-1(1-34) | 1651 |
| DCLGFMRKCEPD[2-Abu]DKCCRPNLVCSRTHDWCKYVF-{Amide} | [Glu10;2-Abu13;Asp28]GpTx-1(1-34) | 1652 |
| DCLGFMRKCDPD[2-Abu]DKCCRPNLVCSRTHDWCKYVF-{Amide} | [Asp10,28;2-Abu13]GpTx-1(1-34) | 1653 |
| DCLGFFRKCIPD[2-Abu]DKCCRPNLVCSRTHDWCKYVF-{Amide} | [Phe6;2-Abu13;Asp28]GpTx-1(1-34) | 1654 |
| DCLGFLRKCIPD[2-Abu]DKCCRPNLVCSRTHDWCKYVF-{Amide} | [Leu6;2-Abu13;Asp28]GpTx-1(1-34) | 1655 |
| DCLGF[Nle]RKCIPD[2-Abu]DKCCRPNLVCSRTHDWCKYVF-{Amide} | [Nle6;2-Abu13;Asp28]GpTx-1(1-34) | 1656 |
| DCLGGMRKCIPD[2-Abu]DKCCRPNLVCSRTHDWCKYVF-{Amide} | [Gly5;2-Abu13;Asp28]GpTx-1(1-34) | 1657 |

TABLE 5B-continued

| Amino acid sequences of GpTx-1 and GpTx-1 peptide analogs. -{Amide} = amidated C-terminal. | | |
|---|---|---|
| Amino Acid Sequence | Designation | SEQ ID NO. |
| DCLGAMRKCIPD[2-Abu]DKCCRPNLVCSRTHDWCKYVF-{Amide} | [Ala5;2-Abu13;Asp28]GpTx-1(1-34) | 1658 |
| DCLG[2-Abu]MRKCIPD[2-Abu]DKCCRPNLVCSRTHDWCKYVF-{Amide} | [2-Abu5,13;Asp28]GpTx-1(1-34) | 1659 |
| DCLG[Nva]MRKCIPD[2-Abu]DKCCRPNLVCSRTHDWCKYVF-{Amide} | [Nva5;2-Abu13;Asp28]GpTx-1(1-34) | 1660 |
| DCLG[Nle]MRKCIPD[2-Abu]DKCCRPNLVCSRTHDWCKYVF-{Amide} | [Nle5;2-Abu13;Asp28]GpTx-1(1-34) | 1661 |
| DCLGVMRKCIPD[2-Abu]DKCCRPNLVCSRTHDWCKYVF-{Amide} | [Val5;2-Abu13;Asp28]GpTx-1(1-34) | 1662 |
| DCLGLMRKCIPD[2-Abu]DKCCRPNLVCSRTHDWCKYVF-{Amide} | [Leu5;2-Abu13;Asp28]GpTx-1(1-34) | 1663 |
| DCLGIMRKCIPD[2-Abu]DKCCRPNLVCSRTHDWCKYVF-{Amide} | [Ile5;2-Abu13;Asp28]GpTx-1(1-34) | 1664 |
| DCLGFMRKCIED[Pra]DKCCRPNLVCSRTHDWCKYVF-{Amide} | [Glu11;Pra13;Asp28]GpTx-1(1-34) | 1665 |
| DCLGFMRKCEPD[Pra]DKCCRPNLVCSRTHDWCKYVF-{Amide} | [Glu10;Pra13;Asp28]GpTx-1(1-34) | 1666 |
| DCLGFMRKCDPD[Pra]DKCCRPNLVCSRTHDWCKYVF-{Amide} | [Asp10,28;Pra13]GpTx-1(1-34) | 1667 |
| DCLGFFRKCIPD[Pra]DKCCRPNLVCSRTHDWCKYVF-{Amide} | [Phe6;Pra13;Asp28]GpTx-1(1-34) | 1668 |
| DCLGFLRKCIPD[Pra]DKCCRPNLVCSRTHDWCKYVF-{Amide} | [Leu6;Pra13;Asp28]GpTx-1(1-34) | 1669 |
| DCLGF[Nle]RKCIPD[Pra]DKCCRPNLVCSRTHDWCKYVF-{Amide} | [Nle6;Pra13;Asp28]GpTx-1(1-34) | 1670 |
| DCLGGMRKCIPD[Pra]DKCCRPNLVCSRTHDWCKYVF-{Amide} | [Gly5;Pra13;Asp28]GpTx-1(1-34) | 1671 |
| DCLGAMRKCIPD[Pra]DKCCRPNLVCSRTHDWCKYVF-{Amide} | [Ala5;Pra13;Asp28]GpTx-1(1-34) | 1672 |
| DCLG[2-Abu]MRKCIPD[Pra]DKCCRPNLVCSRTHDWCKYVF-{Amide} | [2-Abu5;Pra13;Asp28]GpTx-1(1-34) | 1673 |
| DCLG[Nva]MRKCIPD[Pra]DKCCRPNLVCSRTHDWCKYVF-{Amide} | [Nva5;Pra13;Asp28]GpTx-1(1-34) | 1674 |
| DCLG[Nle]MRKCIPD[Pra]DKCCRPNLVCSRTHDWCKYVF-{Amide} | [Nle5;Pra13;Asp28]GpTx-1(1-34) | 1675 |
| DCLGVMRKCIPD[Pra]DKCCRPNLVCSRTHDWCKYVF-{Amide} | [Val5;Pra13;Asp28]GpTx-1(1-34) | 1676 |
| DCLGLMRKCIPD[Pra]DKCCRPNLVCSRTHDWCKYVF-{Amide} | [Leu5;Pra13;Asp28]GpTx-1(1-34) | 1677 |
| DCLGIMRKCIPD[Pra]DKCCRPNLVCSRTHDWCKYVF-{Amide} | [Ile5;Pra13;Asp28]GpTx-1(1-34) | 1678 |
| DCLGFMRKCIED[2-Abu]DKCCRPNLVCSRLHDWCKYVF-{Amide} | [Glu11;2-Abu13;Leu26;Asp28]GpTx-1(1-34) | 1679 |
| DCLGFMRKCEPD[2-Abu]DKCCRPNLVCSRLHDWCKYVF-{Amide} | [Glu10;2-Abu13;Leu26;Asp28]GpTx-1(1-34) | 1680 |
| DCLGFMRKCDPD[2-Abu]DKCCRPNLVCSRLHDWCKYVF-{Amide} | [Asp10,28;2-Abu13;Leu26]GpTx-1(1-34) | 1681 |
| DCLGFFRKCIPD[2-Abu]DKCCRPNLVCSRLHDWCKYVF-{Amide} | [Phe6;2-Abu13;Leu26;Asp28]GpTx-1(1-34) | 1682 |
| DCLGFLRKCIPD[2-Abu]DKCCRPNLVCSRLHDWCKYVF-{Amide} | [Leu6,26;2-Abu13;Asp28]GpTx-1(1-34) | 1683 |
| DCLGF[Nle]RKCIPD[2-Abu]DKCCRPNLVCSRLHDWCKYVF-{Amide} | [Nle6;2-Abu13;Leu26;Asp28]GpTx-1(1-34) | 1684 |
| DCLGGMRKCIPD[2-Abu]DKCCRPNLVCSRLHDWCKYVF-{Amide} | [Gly5;2-Abu13;Leu26;Asp28]GpTx-1(1-34) | 1685 |
| DCLGAMRKCIPD[2-Abu]DKCCRPNLVCSRLHDWCKYVF-{Amide} | [Ala5;2-Abu13;Leu26;Asp28]GpTx-1(1-34) | 1686 |
| DCLG[2-Abu]MRKCIPD[2-Abu]DKCCRPNLVCSRLHDWCKYVF-{Amide} | [2-Abu5,13;Leu26;Asp28]GpTx-1(1-34) | 1687 |
| DCLG[Nva]MRKCIPD[2-Abu]DKCCRPNLVCSRLHDWCKYVF-{Amide} | [Nva5;2-Abu13;Leu26;Asp28]GpTx-1(1-34) | 1688 |
| DCLG[Nle]MRKCIPD[2-Abu]DKCCRPNLVCSRLHDWCKYVF-{Amide} | [Nle5;2-Abu13;Leu26;Asp28]GpTx-1(1-34) | 1689 |
| DCLGVMRKCIPD[2-Abu]DKCCRPNLVCSRLHDWCKYVF-{Amide} | [Val5;2-Abu13;Leu26;Asp28]GpTx-1(1-34) | 1690 |
| DCLGLMRKCIPD[2-Abu]DKCCRPNLVCSRLHDWCKYVF-{Amide} | [Leu5,26;2-Abu13;Asp28]GpTx-1(1-34) | 1691 |
| DCLGIMRKCIPD[2-Abu]DKCCRPNLVCSRLHDWCKYVF-{Amide} | [Ile5;2-Abu13;Leu26;Asp28]GpTx-1(1-34) | 1692 |
| DCLGFMRKCIED[Pra]DKCCRPNLVCSRLHDWCKYVF-{Amide} | [Glu11;Pra13;Leu26;Asp28]GpTx-1(1-34) | 1693 |
| DCLGFMRKCEPD[Pra]DKCCRPNLVCSRLHDWCKYVF-{Amide} | [Glu10;Pra13;Leu26;Asp28]GpTx-1(1-34) | 1694 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFMRKCDPD[Pra]DKCCRPNLVCSRLHDWCKYVF-{Amide} | [Asp10,28;Pra13;Leu26]GpTx-1(1-34) | 1695 |
| DCLGFFRKCIPD[Pra]DKCCRPNLVCSRLHDWCKYVF-{Amide} | [Phe6;Pra13;Leu26;Asp28]GpTx-1(1-34) | 1696 |
| DCLGFLRKCIPD[Pra]DKCCRPNLVCSRLHDWCKYVF-{Amide} | [Leu6,26;Pra13;Asp28]GpTx-1(1-34) | 1697 |
| DCLGF[Nle]RKCIPD[Pra]DKCCRPNLVCSRLHDWCKYVF-{Amide} | [Nle6;Pra13;Leu26;Asp28]GpTx-1(1-34) | 1698 |
| DCLGGMRKCIPD[Pra]DKCCRPNLVCSRLHDWCKYVF-{Amide} | [Gly5;Pra13;Leu26;Asp28]GpTx-1(1-34) | 1699 |
| DCLGAMRKCIPD[Pra]DKCCRPNLVCSRLHDWCKYVF-{Amide} | [Ala5;Pra13;Leu26;Asp28]GpTx-1(1-34) | 1700 |
| DCLG[2-Abu]MRKCIPD[Pra]DKCCRPNLVCSRLHDWCKYVF-{Amide} | [2-Abu5;Pra13;Leu26;Asp28]GpTx-1(1-34) | 1701 |
| DCLG[Nva]MRKCIPD[Pra]DKCCRPNLVCSRLHDWCKYVF-{Amide} | [Nva5;Pra13;Leu26;Asp28]GpTx-1(1-34) | 1702 |
| DCLG[Nle]MRKCIPD[Pra]DKCCRPNLVCSRLHDWCKYVF-{Amide} | [Nle5;Pra13;Leu26;Asp28]GpTx-1(1-34) | 1703 |
| DCLGVMRKCIPD[Pra]DKCCRPNLVCSRLHDWCKYVF-{Amide} | [Val5;Pra13;Leu26;Asp28]GpTx-1(1-34) | 1704 |
| DCLGLMRKCIPD[Pra]DKCCRPNLVCSRLHDWCKYVF-{Amide} | [Leu5,26;Pra13;Asp28]GpTx-1(1-34) | 1705 |
| DCLGIMRKCIPD[Pra]DKCCRPNLVCSRLHDWCKYVF-{Amide} | [Ile5;Pra13;Leu26;Asp28]GpTx-1(1-34) | 1706 |
| DCLGFFRKCIED[2-Abu]DKCCRPNLVCSRTHDWCKYVF-{Amide} | [Phe6;Glu11;2-Abu13;Asp28]GpTx-1(1-34) | 1707 |
| DCLGFLRKCIED[2-Abu]DKCCRPNLVCSRTHDWCKYVF-{Amide} | [Leu6;Glu11;2-Abu13;Asp28]GpTx-1(1-34) | 1708 |
| DCLGF[Nle]RKCIED[2-Abu]DKCCRPNLVCSRTHDWCKYVF-{Amide} | [Nle6;Glu11;2-Abu13;Asp28]GpTx-1(1-34) | 1709 |
| DCLGGMRKCIED[2-Abu]DKCCRPNLVCSRTHDWCKYVF-{Amide} | [Gly5;Glu11;2-Abu13;Asp28]GpTx-1(1-34) | 1710 |
| DCLGAMRKCIED[2-Abu]DKCCRPNLVCSRTHDWCKYVF-{Amide} | [Ala5;Glu11;2-Abu13;Asp28]GpTx-1(1-34) | 1711 |
| DCLG[2-Abu]MRKCIED[2-Abu]DKCCRPNLVCSRTHDWCKYVF-{Amide} | [2-Abu5,13;Glu11;Asp28]GpTx-1(1-34) | 1712 |
| DCLG[Nva]MRKCIED[2-Abu]DKCCRPNLVCSRTHDWCKYVF-{Amide} | [Nva5;Glu11;2-Abu13;Asp28]GpTx-1(1-34) | 1713 |
| DCLG[Nle]MRKCIED[2-Abu]DKCCRPNLVCSRTHDWCKYVF-{Amide} | [Nle5;Glu11;2-Abu13;Asp28]GpTx-1(1-34) | 1714 |
| DCLGVMRKCIED[2-Abu]DKCCRPNLVCSRTHDWCKYVF-{Amide} | [Val5;Glu11;2-Abu13;Asp28]GpTx-1(1-34) | 1715 |
| DCLGLMRKCIED[2-Abu]DKCCRPNLVCSRTHDWCKYVF-{Amide} | [Leu5;Glu11;2-Abu13;Asp28]GpTx-1(1-34) | 1716 |
| DCLGIMRKCIED[2-Abu]DKCCRPNLVCSRTHDWCKYVF-{Amide} | [Ile5;Glu11;2-Abu13;Asp28]GpTx-1(1-34) | 1717 |
| DCLGFFRKCEPD[2-Abu]DKCCRPNLVCSRTHDWCKYVF-{Amide} | [Phe6;Glu10;2-Abu13;Asp28]GpTx-1(1-34) | 1718 |
| DCLGFLRKCEPD[2-Abu]DKCCRPNLVCSRTHDWCKYVF-{Amide} | [Leu6;Glu10;2-Abu13;Asp28]GpTx-1(1-34) | 1719 |
| DCLGF[Nle]RKCEPD[2-Abu]DKCCRPNLVCSRTHDWCKYVF-{Amide} | [Nle6;Glu10;2-Abu13;Asp28]GpTx-1(1-34) | 1720 |
| DCLGGMRKCEPD[2-Abu]DKCCRPNLVCSRTHDWCKYVF-{Amide} | [Gly5;Glu10;2-Abu13;Asp28]GpTx-1(1-34) | 1721 |
| DCLGAMRKCEPD[2-Abu]DKCCRPNLVCSRTHDWCKYVF-{Amide} | [Ala5;Glu10;2-Abu13;Asp28]GpTx-1(1-34) | 1722 |
| DCLG[2-Abu]MRKCEPD[2-Abu]DKCCRPNLVCSRTHDWCKYVF-{Amide} | [2-Abu5,13;Glu10;Asp28]GpTx-1(1-34) | 1723 |
| DCLG[Nva]MRKCEPD[2-Abu]DKCCRPNLVCSRTHDWCKYVF-{Amide} | [Nva5;Glu10;2-Abu13;Asp28]GpTx-1(1-34) | 1724 |
| DCLG[Nle]MRKCEPD[2-Abu]DKCCRPNLVCSRTHDWCKYVF-{Amide} | [Nle5;Glu10;2-Abu13;Asp28]GpTx-1(1-34) | 1725 |
| DCLGVMRKCEPD[2-Abu]DKCCRPNLVCSRTHDWCKYVF-{Amide} | [Val5;Glu10;2-Abu13;Asp28]GpTx-1(1-34) | 1726 |
| DCLGLMRKCEPD[2-Abu]DKCCRPNLVCSRTHDWCKYVF-{Amide} | [Leu5;Glu10;2-Abu13;Asp28]GpTx-1(1-34) | 1727 |
| DCLGIMRKCEPD[2-Abu]DKCCRPNLVCSRTHDWCKYVF-{Amide} | [Ile5;Glu10;2-Abu13;Asp28]GpTx-1(1-34) | 1728 |
| DCLGFFRKCDPD[2-Abu]DKCCRPNLVCSRTHDWCKYVF-{Amide} | [Phe6;Asp10,28;2-Abu13]GpTx-1(1-34) | 1729 |
| DCLGFLRKCDPD[2-Abu]DKCCRPNLVCSRTHDWCKYVF-{Amide} | [Leu6;Asp10,28;2-Abu13]GpTx-1(1-34) | 1730 |
| DCLGF[Nle]RKCDPD[2-Abu]DKCCRPNLVCSRTHDWCKYVF-{Amide} | [Nle6;Asp10,28;2-Abu13]GpTx-1(1-34) | 1731 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGMRKCDPD[2-Abu]DKCCRPNLVCSRTHDWCKYVF-{Amide} | [Gly5;Asp10,28;2-Abu13]GpTx-1(1-34) | 1732 |
| DCLGAMRKCDPD[2-Abu]DKCCRPNLVCSRTHDWCKYVF-{Amide} | [Ala5;Asp10,28;2-Abu13]GpTx-1(1-34) | 1733 |
| DCLG[2-Abu]MRKCDPD[2-Abu]DKCCRPNLVCSRTHDWCKYVF-{Amide} | [2-Abu5,13;Asp10,28]GpTx-1(1-34) | 1734 |
| DCLG[Nva]MRKCDPD[2-Abu]DKCCRPNLVCSRTHDWCKYVF-{Amide} | [Nva5;Asp10,28;2-Abu13]GpTx-1(1-34) | 1735 |
| DCLG[Nle]MRKCDPD[2-Abu]DKCCRPNLVCSRTHDWCKYVF-{Amide} | [Nle5;Asp10,28;2-Abu13]GpTx-1(1-34) | 1736 |
| DCLGVMRKCDPD[2-Abu]DKCCRPNLVCSRTHDWCKYVF-{Amide} | [Val5;Asp10,28;2-Abu13]GpTx-1(1-34) | 1737 |
| DCLGLMRKCDPD[2-Abu]DKCCRPNLVCSRTHDWCKYVF-{Amide} | [Leu5;Asp10,28;2-Abu13]GpTx-1(1-34) | 1738 |
| DCLGIMRKCDPD[2-Abu]DKCCRPNLVCSRTHDWCKYVF-{Amide} | [Ile5;Asp10,28;2-Abu13]GpTx-1(1-34) | 1739 |
| DCLGGFRKCIPD[2-Abu]DKCCRPNLVCSRTHDWCKYVF-{Amide} | [Gly5;Phe6;2-Abu13;Asp28]GpTx-1(1-34) | 1740 |
| DCLGAFRKCIPD[2-Abu]DKCCRPNLVCSRTHDWCKYVF-{Amide} | [Ala5;Phe6;2-Abu13;Asp28]GpTx-1(1-34) | 1741 |
| DCLG[2-Abu]FRKCIPD[2-Abu]DKCCRPNLVCSRTHDWCKYVF-{Amide} | [2-Abu5,13;Phe6;Asp28]GpTx-1(1-34) | 1742 |
| DCLG[Nva]FRKCIPD[2-Abu]DKCCRPNLVCSRTHDWCKYVF-{Amide} | [Nva5;Phe6;2-Abu13;Asp28]GpTx-1(1-34) | 1743 |
| DCLG[Nle]FRKCIPD[2-Abu]DKCCRPNLVCSRTHDWCKYVF-{Amide} | [Nle5;Phe6;2-Abu13;Asp28]GpTx-1(1-34) | 1744 |
| DCLGVFRKCIPD[2-Abu]DKCCRPNLVCSRTHDWCKYVF-{Amide} | [Val5;Phe6;2-Abu13;Asp28]GpTx-1(1-34) | 1745 |
| DCLGLFRKCIPD[2-Abu]DKCCRPNLVCSRTHDWCKYVF-{Amide} | [Leu5;Phe6;2-Abu13;Asp28]GpTx-1(1-34) | 1746 |
| DCLGIFRKCIPD[2-Abu]DKCCRPNLVCSRTHDWCKYVF-{Amide} | [Ile5;Phe6;2-Abu13;Asp28]GpTx-1(1-34) | 1747 |
| DCLGGLRKCIPD[2-Abu]DKCCRPNLVCSRTHDWCKYVF-{Amide} | [Gly5;Leu6;2-Abu13;Asp28]GpTx-1(1-34) | 1748 |
| DCLGALRKCIPD[2-Abu]DKCCRPNLVCSRTHDWCKYVF-{Amide} | [Ala5;Leu6;2-Abu13;Asp28]GpTx-1(1-34) | 1749 |
| DCLG[2-Abu]LRKCIPD[2-Abu]DKCCRPNLVCSRTHDWCKYVF-{Amide} | [2-Abu5,13;Leu6;Asp28]GpTx-1(1-34) | 1750 |
| DCLG[Nva]LRKCIPD[2-Abu]DKCCRPNLVCSRTHDWCKYVF-{Amide} | [Nva5;Leu6;2-Abu13;Asp28]GpTx-1(1-34) | 1751 |
| DCLG[Nle]LRKCIPD[2-Abu]DKCCRPNLVCSRTHDWCKYVF-{Amide} | [Nle5;Leu6;2-Abu13;Asp28]GpTx-1(1-34) | 1752 |
| DCLGVLRKCIPD[2-Abu]DKCCRPNLVCSRTHDWCKYVF-{Amide} | [Val5;Leu6;2-Abu13;Asp28]GpTx-1(1-34) | 1753 |
| DCLGLLRKCIPD[2-Abu]DKCCRPNLVCSRTHDWCKYVF-{Amide} | [Leu5,6;2-Abu13;Asp28]GpTx-1(1-34) | 1754 |
| DCLGILRKCIPD[2-Abu]DKCCRPNLVCSRTHDWCKYVF-{Amide} | [Ile5;Leu6;2-Abu13;Asp28]GpTx-1(1-34) | 1755 |
| DCLGG[Nle]RKCIPD[2-Abu]DKCCRPNLVCSRTHDWCKYVF-{Amide} | [Gly5;Nle6;2-Abu13;Asp28]GpTx-1(1-34) | 1756 |
| DCLGA[Nle]RKCIPD[2-Abu]DKCCRPNLVCSRTHDWCKYVF-{Amide} | [Ala5;Nle6;2-Abu13;Asp28]GpTx-1(1-34) | 1757 |
| DCLG[2-Abu][Nle]RKCIPD[2-Abu]DKCCRPNLVCSRTHDWCKYVF-{Amide} | [2-Abu5,13;Nle6;Asp28]GpTx-1(1-34) | 1758 |
| DCLG[Nva][Nle]RKCIPD[2-Abu]DKCCRPNLVCSRTHDWCKYVF-{Amide} | [Nva5;Nle6;2-Abu13;Asp28]GpTx-1(1-34) | 1759 |
| DCLG[Nle][Nle]RKCIPD[2-Abu]DKCCRPNLVCSRTHDWCKYVF-{Amide} | [Nle5,6;2-Abu13;Asp28]GpTx-1(1-34) | 1760 |
| DCLGV[Nle]RKCIPD[2-Abu]DKCCRPNLVCSRTHDWCKYVF-{Amide} | [Val5;Nle6;2-Abu13;Asp28]GpTx-1(1-34) | 1761 |
| DCLGL[Nle]RKCIPD[2-Abu]DKCCRPNLVCSRTHDWCKYVF-{Amide} | [Leu5;Nle6;2-Abu13;Asp28]GpTx-1(1-34) | 1762 |
| DCLGI[Nle]RKCIPD[2-Abu]DKCCRPNLVCSRTHDWCKYVF-{Amide} | [Ile5;Nle6;2-Abu13;Asp28]GpTx-1(1-34) | 1763 |
| DCLGFFRKCIED[Pra]DKCCRPNLVCSRTHDWCKYVF-{Amide} | [Phe6;Glu11;Pra13;Asp28]GpTx-1(1-34) | 1764 |
| DCLGFLRKCIED[Pra]DKCCRPNLVCSRTHDWCKYVF-{Amide} | [Leu6;Glu11;Pra13;Asp28]GpTx-1(1-34) | 1765 |
| DCLGF[Nle]RKCIED[Pra]DKCCRPNLVCSRTHDWCKYVF-{Amide} | [Nle6;Glu11;Pra13;Asp28]GpTx-1(1-34) | 1766 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGMRKCIED[Pra]DKCCRPNLVCSRTHDWCKYVF-{Amide} | [Gly5;Glu11;Pra13;Asp28]GpTx-1(1-34) | 1767 |
| DCLGAMRKCIED[Pra]DKCCRPNLVCSRTHDWCKYVF-{Amide} | [Ala5;Glu11;Pra13;Asp28]GpTx-1(1-34) | 1768 |
| DCLG[2-Abu]MRKCIED[Pra]DKCCRPNLVCSRTHDWCKYVF-{Amide} | [2-Abu5;Glu11;Pra13;Asp28]GpTx-1(1-34) | 1769 |
| DCLG[Nva]MRKCIED[Pra]DKCCRPNLVCSRTHDWCKYVF-{Amide} | [Nva5;Glu11;Pra13;Asp28]GpTx-1(1-34) | 1770 |
| DCLG[Nle]MRKCIED[Pra]DKCCRPNLVCSRTHDWCKYVF-{Amide} | [Nle5;Glu11;Pra13;Asp28]GpTx-1(1-34) | 1771 |
| DCLGVMRKCIED[Pra]DKCCRPNLVCSRTHDWCKYVF-{Amide} | [Val5;Glu11;Pra13;Asp28]GpTx-1(1-34) | 1772 |
| DCLGLMRKCIED[Pra]DKCCRPNLVCSRTHDWCKYVF-{Amide} | [Leu5;Glu11;Pra13;Asp28]GpTx-1(1-34) | 1773 |
| DCLGIMRKCIED[Pra]DKCCRPNLVCSRTHDWCKYVF-{Amide} | [Ile5;Glu11;Pra13;Asp28]GpTx-1(1-34) | 1774 |
| DCLGFFRKCEPD[Pra]DKCCRPNLVCSRTHDWCKYVF-{Amide} | [Phe6;Glu10;Pra13;Asp28]GpTx-1(1-34) | 1775 |
| DCLGFLRKCEPD[Pra]DKCCRPNLVCSRTHDWCKYVF-{Amide} | [Leu6;Glu10;Pra13;Asp28]GpTx-1(1-34) | 1776 |
| DCLGF[Nle]RKCEPD[Pra]DKCCRPNLVCSRTHDWCKYVF-{Amide} | [Nle6;Glu10;Pra13;Asp28]GpTx-1(1-34) | 1777 |
| DCLGGMRKCEPD[Pra]DKCCRPNLVCSRTHDWCKYVF-{Amide} | [Gly5;Glu10;Pra13;Asp28]GpTx-1(1-34) | 1778 |
| DCLGAMRKCEPD[Pra]DKCCRPNLVCSRTHDWCKYVF-{Amide} | [Ala5;Glu10;Pra13;Asp28]GpTx-1(1-34) | 1779 |
| DCLG[2-Abu]MRKCEPD[Pra]DKCCRPNLVCSRTHDWCKYVF-{Amide} | [2-Abu5;Glu10;Pra13;Asp28]GpTx-1(1-34) | 1780 |
| DCLG[Nva]MRKCEPD[Pra]DKCCRPNLVCSRTHDWCKYVF-{Amide} | [Nva5;Glu10;Pra13;Asp28]GpTx-1(1-34) | 1781 |
| DCLG[Nle]MRKCEPD[Pra]DKCCRPNLVCSRTHDWCKYVF-{Amide} | [Nle5;Glu10;Pra13;Asp28]GpTx-1(1-34) | 1782 |
| DCLGVMRKCEPD[Pra]DKCCRPNLVCSRTHDWCKYVF-{Amide} | [Val5;Glu10;Pra13;Asp28]GpTx-1(1-34) | 1783 |
| DCLGLMRKCEPD[Pra]DKCCRPNLVCSRTHDWCKYVF-{Amide} | [Leu5;Glu10;Pra13;Asp28]GpTx-1(1-34) | 1784 |
| DCLGIMRKCEPD[Pra]DKCCRPNLVCSRTHDWCKYVF-{Amide} | [Ile5;Glu10;Pra13;Asp28]GpTx-1(1-34) | 1785 |
| DCLGFFRKCDPD[Pra]DKCCRPNLVCSRTHDWCKYVF-{Amide} | [Phe6;Asp10,28;Pra13]GpTx-1(1-34) | 1786 |
| DCLGFLRKCDPD[Pra]DKCCRPNLVCSRTHDWCKYVF-{Amide} | [Leu6;Asp10,28;Pra13]GpTx-1(1-34) | 1787 |
| DCLGF[Nle]RKCDPD[Pra]DKCCRPNLVCSRTHDWCKYVF-{Amide} | [Nle6;Asp10,28;Pra13]GpTx-1(1-34) | 1788 |
| DCLGGMRKCDPD[Pra]DKCCRPNLVCSRTHDWCKYVF-{Amide} | [Gly5;Asp10,28;Pra13]GpTx-1(1-34) | 1789 |
| DCLGAMRKCDPD[Pra]DKCCRPNLVCSRTHDWCKYVF-{Amide} | [Ala5;Asp10,28;Pra13]GpTx-1(1-34) | 1790 |
| DCLG[2-Abu]MRKCDPD[Pra]DKCCRPNLVCSRTHDWCKYVF-{Amide} | [2-Abu5;Asp10,28;Pra13]GpTx-1(1-34) | 1791 |
| DCLG[Nva]MRKCDPD[Pra]DKCCRPNLVCSRTHDWCKYVF-{Amide} | [Nva5;Asp10,28;Pra13]GpTx-1(1-34) | 1792 |
| DCLG[Nle]MRKCDPD[Pra]DKCCRPNLVCSRTHDWCKYVF-{Amide} | [Nle5;Asp10,28;Pra13]GpTx-1(1-34) | 1793 |
| DCLGVMRKCDPD[Pra]DKCCRPNLVCSRTHDWCKYVF-{Amide} | [Val5;Asp10,28;Pra13]GpTx-1(1-34) | 1794 |
| DCLGLMRKCDPD[Pra]DKCCRPNLVCSRTHDWCKYVF-{Amide} | [Leu5;Asp10,28;Pra13]GpTx-1(1-34) | 1795 |
| DCLGIMRKCDPD[Pra]DKCCRPNLVCSRTHDWCKYVF-{Amide} | [Ile5;Asp10,28;Pra13]GpTx-1(1-34) | 1796 |
| DCLGGFRKCIPD[Pra]DKCCRPNLVCSRTHDWCKYVF-{Amide} | [Gly5;Phe6;Pra13;Asp28]GpTx-1(1-34) | 1797 |
| DCLGAFRKCIPD[Pra]DKCCRPNLVCSRTHDWCKYVF-{Amide} | [Ala5;Phe6;Pra13;Asp28]GpTx-1(1-34) | 1798 |
| DCLG[2-Abu]FRKCIPD[Pra]DKCCRPNLVCSRTHDWCKYVF-{Amide} | [2-Abu5;Phe6;Pra13;Asp28]GpTx-1(1-34) | 1799 |
| DCLG[Nva]FRKCIPD[Pra]DKCCRPNLVCSRTHDWCKYVF-{Amide} | [Nva5;Phe6;Pra13;Asp28]GpTx-1(1-34) | 1800 |
| DCLG[Nle]FRKCIPD[Pra]DKCCRPNLVCSRTHDWCKYVF-{Amide} | [Nle5;Phe6;Pra13;Asp28]GpTx-1(1-34) | 1801 |
| DCLGVFRKCIPD[Pra]DKCCRPNLVCSRTHDWCKYVF-{Amide} | [Val5;Phe6;Pra13;Asp28]GpTx-1(1-34) | 1802 |
| DCLGLFRKCIPD[Pra]DKCCRPNLVCSRTHDWCKYVF-{Amide} | [Leu5;Phe6;Pra13;Asp28]GpTx-1(1-34) | 1803 |

TABLE 5B-continued

| Amino acid sequences of GpTx-1 and GpTx-1 peptide analogs. -{Amide} = amidated C-terminal. | | |
|---|---|---|
| Amino Acid Sequence | Designation | SEQ ID NO. |
| DCLGIFRKCIPD[Pra]DKCCRPNLVCSRTHDWCKYVF-{Amide} | [Ile5;Phe6;Pra13;Asp28]GpTx-1(1-34) | 1804 |
| DCLGGLRKCIPD[Pra]DKCCRPNLVCSRTHDWCKYVF-{Amide} | [Gly5;Leu6;Pra13;Asp28]GpTx-1(1-34) | 1805 |
| DCLGALRKCIPD[Pra]DKCCRPNLVCSRTHDWCKYVF-{Amide} | [Ala5;Leu6;Pra13;Asp28]GpTx-1(1-34) | 1806 |
| DCLG[2-Abu]LRKCIPD[Pra]DKCCRPNLVCSRTHDWCKYVF-{Amide} | [2-Abu5;Leu6;Pra13;Asp28]GpTx-1(1-34) | 1807 |
| DCLG[Nva]LRKCIPD[Pra]DKCCRPNLVCSRTHDWCKYVF-{Amide} | [Nva5;Leu6;Pra13;Asp28]GpTx-1(1-34) | 1808 |
| DCLG[Nle]LRKCIPD[Pra]DKCCRPNLVCSRTHDWCKYVF-{Amide} | [Nle5;Leu6;Pra13;Asp28]GpTx-1(1-34) | 1809 |
| DCLGVLRKCIPD[Pra]DKCCRPNLVCSRTHDWCKYVF-{Amide} | [Val5;Leu6;Pra13;Asp28]GpTx-1(1-34) | 1810 |
| DCLGLLRKCIPD[Pra]DKCCRPNLVCSRTHDWCKYVF-{Amide} | [Leu5,6;Pra13;Asp28]GpTx-1(1-34) | 1811 |
| DCLGILRKCIPD[Pra]DKCCRPNLVCSRTHDWCKYVF-{Amide} | [Ile5;Leu6;Pra13;Asp28]GpTx-1(1-34) | 1812 |
| DCLGG[Nle]RKCIPD[Pra]DKCCRPNLVCSRTHDWCKYVF-{Amide} | [Gly5;Nle6;Pra13;Asp28]GpTx-1(1-34) | 1813 |
| DCLGA[Nle]RKCIPD[Pra]DKCCRPNLVCSRTHDWCKYVF-{Amide} | [Ala5;Nle6;Pra13;Asp28]GpTx-1(1-34) | 1814 |
| DCLG[2-Abu][Nle]RKCIPD[Pra]DKCCRPNLVCSRTHDWCKYVF-{Amide} | [2-Abu5;Nle6;Pra13;Asp28]GpTx-1(1-34) | 1815 |
| DCLG[Nva][Nle]RKCIPD[Pra]DKCCRPNLVCSRTHDWCKYVF-{Amide} | [Nva5;Nle6;Pra13;Asp28]GpTx-1(1-34) | 1816 |
| DCLG[Nle][Nle]RKCIPD[Pra]DKCCRPNLVCSRTHDWCKYVF-{Amide} | [Nle5,6;Pra13;Asp28]GpTx-1(1-34) | 1817 |
| DCLGV[Nle]RKCIPD[Pra]DKCCRPNLVCSRTHDWCKYVF-{Amide} | [Val5;Nle6;Pra13;Asp28]GpTx-1(1-34) | 1818 |
| DCLGL[Nle]RKCIPD[Pra]DKCCRPNLVCSRTHDWCKYVF-{Amide} | [Leu5;Nle6;Pra13;Asp28]GpTx-1(1-34) | 1819 |
| DCLGI[Nle]RKCIPD[Pra]DKCCRPNLVCSRTHDWCKYVF-{Amide} | [Ile5;Nle6;Pra13;Asp28]GpTx-1(1-34) | 1820 |
| DCLGFFRKCIED[2-Abu]DKCCRPNLVCSRLHDWCKYVF-{Amide} | [Phe6;Glu11;2-Abu13;Leu26;Asp28]GpTx-1(1-34) | 1821 |
| DCLGFLRKCIED[2-Abu]DKCCRPNLVCSRLHDWCKYVF-{Amide} | [Leu6,26;Glu11;2-Abu13;Asp28]GpTx-1(1-34) | 1822 |
| DCLGF[Nle]RKCIED[2-Abu]DKCCRPNLVCSRLHDWCKYVF-{Amide} | [Nle6;Glu11;2-Abu13;Leu26;Asp28]GpTx-1(1-34) | 1823 |
| DCLGGMRKCIED[2-Abu]DKCCRPNLVCSRLHDWCKYVF-{Amide} | [Gly5;Glu11;2-Abu13;Leu26;Asp28]GpTx-1(1-34) | 1824 |
| DCLGAMRKCIED[2-Abu]DKCCRPNLVCSRLHDWCKYVF-{Amide} | [Ala5;Glu11;2-Abu13;Leu26;Asp28]GpTx-1(1-34) | 1825 |
| DCLG[2-Abu]MRKCIED[2-Abu]DKCCRPNLVCSRLHDWCKYVF-{Amide} | [2-Abu5,13;Glu11;Leu26;Asp28]GpTx-1(1-34) | 1826 |
| DCLG[Nva]MRKCIED[2-Abu]DKCCRPNLVCSRLHDWCKYVF-{Amide} | [Nva5;Glu11;2-Abu13;Leu26;Asp28]GpTx-1(1-34) | 1827 |
| DCLG[Nle]MRKCIED[2-Abu]DKCCRPNLVCSRLHDWCKYVF-{Amide} | [Nle5;Glu11;2-Abu13;Leu26;Asp28]GpTx-1(1-34) | 1828 |
| DCLGVMRKCIED[2-Abu]DKCCRPNLVCSRLHDWCKYVF-{Amide} | [Val5;Glu11;2-Abu13;Leu26;Asp28]GpTx-1(1-34) | 1829 |
| DCLGLMRKCIED[2-Abu]DKCCRPNLVCSRLHDWCKYVF-{Amide} | [Leu5,26;Glu11;2-Abu13;Asp28]GpTx-1(1-34) | 1830 |
| DCLGIMRKCIED[2-Abu]DKCCRPNLVCSRLHDWCKYVF-{Amide} | [Ile5;Glu11;2-Abu13;Leu26;Asp28]GpTx-1(1-34) | 1831 |
| DCLGFFRKCEPD[2-Abu]DKCCRPNLVCSRLHDWCKYVF-{Amide} | [Phe6;Glu10;2-Abu13;Leu26;Asp28]GpTx-1(1-34) | 1832 |
| DCLGFLRKCEPD[2-Abu]DKCCRPNLVCSRLHDWCKYVF-{Amide} | [Leu6,26;Glu10;2-Abu13;Asp28]GpTx-1(1-34) | 1833 |
| DCLGF[Nle]RKCEPD[2-Abu]DKCCRPNLVCSRLHDWCKYVF-{Amide} | [Nle6;Glu10;2-Abu13;Leu26;Asp28]GpTx-1(1-34) | 1834 |
| DCLGGMRKCEPD[2-Abu]DKCCRPNLVCSRLHDWCKYVF-{Amide} | [Gly5;Glu10;2-Abu13;Leu26;Asp28]GpTx-1(1-34) | 1835 |
| DCLGAMRKCEPD[2-Abu]DKCCRPNLVCSRLHDWCKYVF-{Amide} | [Ala5;Glu10;2-Abu13;Leu26;Asp28]GpTx-1(1-34) | 1836 |
| DCLG[2-Abu]MRKCEPD[2-Abu]DKCCRPNLVCSRLHDWCKYVF-{Amide} | [2-Abu5,13;Glu10;Leu26;Asp28]GpTx-1(1-34) | 1837 |
| DCLG[Nva]MRKCEPD[2-Abu]DKCCRPNLVCSRLHDWCKYVF-{Amide} | [Nva5;Glu10;2-Abu13;Leu26;Asp28]GpTx-1(1-34) | 1838 |
| DCLG[Nle]MRKCEPD[2-Abu]DKCCRPNLVCSRLHDWCKYVF-{Amide} | [Nle5;Glu10;2-Abu13;Leu26;Asp28]GpTx-1(1-34) | 1839 |
| DCLGVMRKCEPD[2-Abu]DKCCRPNLVCSRLHDWCKYVF-{Amide} | [Val5;Glu10;2-Abu13;Leu26;Asp28]GpTx-1(1-34) | 1840 |

TABLE 5B-continued

| Amino Acid Sequence | Designation | SEQ ID NO. |
|---|---|---|
| Amino acid sequences of GpTx-1 and GpTx-1 peptide analogs. -{Amide} = amidated C-terminal. | | |
| DCLGLMRKCEPD[2-Abu]DKCCRPNLVCSRLHDWCKYVF-{Amide} | [Leu5,26;Glu10;2-Abu13;Asp28]GpTx-1(1-34) | 1841 |
| DCLGIMRKCEPD[2-Abu]DKCCRPNLVCSRLHDWCKYVF-{Amide} | [Ile5;Glu10;2-Abu13;Leu26;Asp28]GpTx-1(1-34) | 1842 |
| DCLGFFRKCDPD[2-Abu]DKCCRPNLVCSRLHDWCKYVF-{Amide} | [Phe6;Asp10,28;2-Abu13;Leu26]GpTx-1(1-34) | 1843 |
| DCLGFLRKCDPD[2-Abu]DKCCRPNLVCSRLHDWCKYVF-{Amide} | [Leu6,26;Asp10,28;2-Abu13]GpTx-1(1-34) | 1844 |
| DCLGF[Nle]RKCDPD[2-Abu]DKCCRPNLVCSRLHDWCKYVF-{Amide} | [Nle6;Asp10,28;2-Abu13;Leu26]GpTx-1(1-34) | 1845 |
| DCLGGMRKCDPD[2-Abu]DKCCRPNLVCSRLHDWCKYVF-{Amide} | [Gly5;Asp10,28;2-Abu13;Leu26]GpTx-1(1-34) | 1846 |
| DCLGAMRKCDPD[2-Abu]DKCCRPNLVCSRLHDWCKYVF-{Amide} | [Ala5;Asp10,28;2-Abu13;Leu26]GpTx-1(1-34) | 1847 |
| DCLG[2-Abu]MRKCDPD[2-Abu]DKCCRPNLVCSRLHDWCKYVF-{Amide} | [2-Abu5,13;Asp10,28;Leu26]GpTx-1(1-34) | 1848 |
| DCLG[Nva]MRKCDPD[2-Abu]DKCCRPNLVCSRLHDWCKYVF-{Amide} | [Nva5;Asp10,28;2-Abu13;Leu26]GpTx-1(1-34) | 1849 |
| DCLG[Nle]MRKCDPD[2-Abu]DKCCRPNLVCSRLHDWCKYVF-{Amide} | [Nle5;Asp10,28;2-Abu13;Leu26]GpTx-1(1-34) | 1850 |
| DCLGVMRKCDPD[2-Abu]DKCCRPNLVCSRLHDWCKYVF-{Amide} | [Val5;Asp10,28;2-Abu13;Leu26]GpTx-1(1-34) | 1851 |
| DCLGLMRKCDPD[2-Abu]DKCCRPNLVCSRLHDWCKYVF-{Amide} | [Leu5,26;Asp10,28;2-Abu13]GpTx-1(1-34) | 1852 |
| DCLGIMRKCDPD[2-Abu]DKCCRPNLVCSRLHDWCKYVF-{Amide} | [Ile5;Asp10,28;2-Abu13;Leu26]GpTx-1(1-34) | 1853 |
| DCLGGFRKCIPD[2-Abu]DKCCRPNLVCSRLHDWCKYVF-{Amide} | [Gly5;Phe6;2-Abu13;Leu26;Asp28]GpTx-1(1-34) | 1854 |
| DCLGAFRKCIPD[2-Abu]DKCCRPNLVCSRLHDWCKYVF-{Amide} | [Ala5;Phe6;2-Abu13;Leu26;Asp28]GpTx-1(1-34) | 1855 |
| DCLG[2-Abu]FRKCIPD[2-Abu]DKCCRPNLVCSRLHDWCKYVF-{Amide} | [2-Abu5,13;Phe6;Leu26;Asp28]GpTx-1(1-34) | 1856 |
| DCLG[Nva]FRKCIPD[2-Abu]DKCCRPNLVCSRLHDWCKYVF-{Amide} | [Nva5;Phe6;2-Abu13;Leu26;Asp28]GpTx-1(1-34) | 1857 |
| DCLG[Nle]FRKCIPD[2-Abu]DKCCRPNLVCSRLHDWCKYVF-{Amide} | [Nle5;Phe6;2-Abu13;Leu26;Asp28]GpTx-1(1-34) | 1858 |
| DCLGVFRKCIPD[2-Abu]DKCCRPNLVCSRLHDWCKYVF-{Amide} | [Val5;Phe6;2-Abu13;Leu26;Asp28]GpTx-1(1-34) | 1859 |
| DCLGLFRKCIPD[2-Abu]DKCCRPNLVCSRLHDWCKYVF-{Amide} | [Leu5,26;Phe6;2-Abu13;Asp28]GpTx-1(1-34) | 1860 |
| DCLGIFRKCIPD[2-Abu]DKCCRPNLVCSRLHDWCKYVF-{Amide} | [Ile5;Phe6;2-Abu13;Leu26;Asp28]GpTx-1(1-34) | 1861 |
| DCLGGLRKCIPD[2-Abu]DKCCRPNLVCSRLHDWCKYVF-{Amide} | [Gly5;Leu6,26;2-Abu13;Asp28]GpTx-1(1-34) | 1862 |
| DCLGALRKCIPD[2-Abu]DKCCRPNLVCSRLHDWCKYVF-{Amide} | [Ala5;Leu6,26;2-Abu13;Asp28]GpTx-1(1-34) | 1863 |
| DCLG[2-Abu]LRKCIPD[2-Abu]DKCCRPNLVCSRLHDWCKYVF-{Amide} | [2-Abu5,13;Leu6,26;Asp28]GpTx-1(1-34) | 1864 |
| DCLG[Nva]LRKCIPD[2-Abu]DKCCRPNLVCSRLHDWCKYVF-{Amide} | [Nva5;Leu6,26;2-Abu13;Asp28]GpTx-1(1-34) | 1865 |
| DCLG[Nle]LRKCIPD[2-Abu]DKCCRPNLVCSRLHDWCKYVF-{Amide} | [Nle5;Leu6,26;2-Abu13;Asp28]GpTx-1(1-34) | 1866 |
| DCLGVLRKCIPD[2-Abu]DKCCRPNLVCSRLHDWCKYVF-{Amide} | [Val5;Leu6,26;2-Abu13;Asp28]GpTx-1(1-34) | 1867 |
| DCLGLLRKCIPD[2-Abu]DKCCRPNLVCSRLHDWCKYVF-{Amide} | [Leu5,6,26;2-Abu13;Asp28]GpTx-1(1-34) | 1868 |
| DCLGILRKCIPD[2-Abu]DKCCRPNLVCSRLHDWCKYVF-{Amide} | [Ile5;Leu6,26;2-Abu13;Asp28]GpTx-1(1-34) | 1869 |
| DCLGG[Nle]RKCIPD[2-Abu]DKCCRPNLVCSRLHDWCKYVF-{Amide} | [Gly5;Nle6;2-Abu13;Leu26;Asp28]GpTx-1(1-34) | 1870 |
| DCLGA[Nle]RKCIPD[2-Abu]DKCCRPNLVCSRLHDWCKYVF-{Amide} | [Ala5;Nle6;2-Abu13;Leu26;Asp28]GpTx-1(1-34) | 1871 |
| DCLG[2-Abu][Nle]RKCIPD[2-Abu]DKCCRPNLVCSRLHDWCKYVF-{Amide} | [2-Abu5,13;Nle6;Leu26;Asp28]GpTx-1(1-34) | 1872 |
| DCLG[Nva][Nle]RKCIPD[2-Abu]DKCCRPNLVCSRLHDWCKYVF-{Amide} | [Nva5;Nle6;2-Abu13;Leu26;Asp28]GpTx-1(1-34) | 1873 |
| DCLG[Nle][Nle]RKCIPD[2-Abu]DKCCRPNLVCSRLHDWCKYVF-{Amide} | [Nle5,6;2-Abu13;Leu26;Asp28]GpTx-1(1-34) | 1874 |
| DCLGV[Nle]RKCIPD[2-Abu]DKCCRPNLVCSRLHDWCKYVF-{Amide} | [Val5;Nle6;2-Abu13;Leu26;Asp28]GpTx-1(1-34) | 1875 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGL[Nle]RKCIPD[2-Abu]DKCCRPNLVCSRLHDWCKYVF-{Amide} | [Leu5,26;Nle6;2-Abu13;Asp28]GpTx-1(1-34) | 1876 |
| DCLGI[Nle]RKCIPD[2-Abu]DKCCRPNLVCSRLHDWCKYVF-{Amide} | [Ile5;Nle6;2-Abu13;Leu26;Asp28]GpTx-1(1-34) | 1877 |
| DCLGFFRKCIED[Pra]DKCCRPNLVCSRLHDWCKYVF-{Amide} | [Phe6;Glu11;Pra13;Leu26;Asp28]GpTx-1(1-34) | 1878 |
| DCLGFLRKCIED[Pra]DKCCRPNLVCSRLHDWCKYVF-{Amide} | [Leu6,26;Glu11;Pra13;Asp28]GpTx-1(1-34) | 1879 |
| DCLGF[Nle]RKCIED[Pra]DKCCRPNLVCSRLHDWCKYVF-{Amide} | [Nle6;Glu11;Pra13;Leu26;Asp28]GpTx-1(1-34) | 1880 |
| DCLGGMRKCIED[Pra]DKCCRPNLVCSRLHDWCKYVF-{Amide} | [Gly5;Glu11;Pra13;Leu26;Asp28]GpTx-1(1-34) | 1881 |
| DCLGAMRKCIED[Pra]DKCCRPNLVCSRLHDWCKYVF-{Amide} | [Ala5;Glu11;Pra13;Leu26;Asp28]GpTx-1(1-34) | 1882 |
| DCLG[2-Abu]MRKCIED[Pra]DKCCRPNLVCSRLHDWCKYVF-{Amide} | [2-Abu5;Glu11;Pra13;Leu26;Asp28]GpTx-1(1-34) | 1883 |
| DCLG[Nva]MRKCIED[Pra]DKCCRPNLVCSRLHDWCKYVF-{Amide} | [Nva5;Glu11;Pra13;Leu26;Asp28]GpTx-1(1-34) | 1884 |
| DCLG[Nle]MRKCIED[Pra]DKCCRPNLVCSRLHDWCKYVF-{Amide} | [Nle5;Glu11;Pra13;Leu26;Asp28]GpTx-1(1-34) | 1885 |
| DCLGVMRKCIED[Pra]DKCCRPNLVCSRLHDWCKYVF-{Amide} | [Val5;Glu11;Pra13;Leu26;Asp28]GpTx-1(1-34) | 1886 |
| DCLGLMRKCIED[Pra]DKCCRPNLVCSRLHDWCKYVF-{Amide} | [Leu5,26;Glu11;Pra13;Asp28]GpTx-1(1-34) | 1887 |
| DCLGIMRKCIED[Pra]DKCCRPNLVCSRLHDWCKYVF-{Amide} | [Ile5;Glu11;Pra13;Leu26;Asp28]GpTx-1(1-34) | 1888 |
| DCLGFFRKCEPD[Pra]DKCCRPNLVCSRLHDWCKYVF-{Amide} | [Phe6;Glu10;Pra13;Leu26;Asp28]GpTx-1(1-34) | 1889 |
| DCLGFLRKCEPD[Pra]DKCCRPNLVCSRLHDWCKYVF-{Amide} | [Leu6,26;Glu10;Pra13;Asp28]GpTx-1(1-34) | 1890 |
| DCLGF[Nle]RKCEPD[Pra]DKCCRPNLVCSRLHDWCKYVF-{Amide} | [Nle6;Glu10;Pra13;Leu26;Asp28]GpTx-1(1-34) | 1891 |
| DCLGGMRKCEPD[Pra]DKCCRPNLVCSRLHDWCKYVF-{Amide} | [Gly5;Glu10;Pra13;Leu26;Asp28]GpTx-1(1-34) | 1892 |
| DCLGAMRKCEPD[Pra]DKCCRPNLVCSRLHDWCKYVF-{Amide} | [Ala5;Glu10;Pra13;Leu26;Asp28]GpTx-1(1-34) | 1893 |
| DCLG[2-Abu]MRKCEPD[Pra]DKCCRPNLVCSRLHDWCKYVF-{Amide} | [2-Abu5;Glu10;Pra13;Leu26;Asp28]GpTx-1(1-34) | 1894 |
| DCLG[Nva]MRKCEPD[Pra]DKCCRPNLVCSRLHDWCKYVF-{Amide} | [Nva5;Glu10;Pra13;Leu26;Asp28]GpTx-1(1-34) | 1895 |
| DCLG[Nle]MRKCEPD[Pra]DKCCRPNLVCSRLHDWCKYVF-{Amide} | [Nle5;Glu10;Pra13;Leu26;Asp28]GpTx-1(1-34) | 1896 |
| DCLGVMRKCEPD[Pra]DKCCRPNLVCSRLHDWCKYVF-{Amide} | [Val5;Glu10;Pra13;Leu26;Asp28]GpTx-1(1-34) | 1897 |
| DCLGLMRKCEPD[Pra]DKCCRPNLVCSRLHDWCKYVF-{Amide} | [Leu5,26;Glu10;Pra13;Asp28]GpTx-1(1-34) | 1898 |
| DCLGIMRKCEPD[Pra]DKCCRPNLVCSRLHDWCKYVF-{Amide} | [Ile5;Glu10;Pra13;Leu26;Asp28]GpTx-1(1-34) | 1899 |
| DCLGFFRKCDPD[Pra]DKCCRPNLVCSRLHDWCKYVF-{Amide} | [Phe6;Asp10,28;Pra13;Leu26]GpTx-1(1-34) | 1900 |
| DCLGFLRKCDPD[Pra]DKCCRPNLVCSRLHDWCKYVF-{Amide} | [Leu6,26;Asp10,28;Pra13]GpTx-1(1-34) | 1901 |
| DCLGF[Nle]RKCDPD[Pra]DKCCRPNLVCSRLHDWCKYVF-{Amide} | [Nle6;Asp10,28;Pra13;Leu26]GpTx-1(1-34) | 1902 |
| DCLGGMRKCDPD[Pra]DKCCRPNLVCSRLHDWCKYVF-{Amide} | [Gly5;Asp10,28;Pra13;Leu26]GpTx-1(1-34) | 1903 |
| DCLGAMRKCDPD[Pra]DKCCRPNLVCSRLHDWCKYVF-{Amide} | [Ala5;Asp10,28;Pra13;Leu26]GpTx-1(1-34) | 1904 |
| DCLG[2-Abu]MRKCDPD[Pra]DKCCRPNLVCSRLHDWCKYVF-{Amide} | [2-Abu5;Asp10,28;Pra13;Leu26]GpTx-1(1-34) | 1905 |
| DCLG[Nva]MRKCDPD[Pra]DKCCRPNLVCSRLHDWCKYVF-{Amide} | [Nva5;Asp10,28;Pra13;Leu26]GpTx-1(1-34) | 1906 |
| DCLG[Nle]MRKCDPD[Pra]DKCCRPNLVCSRLHDWCKYVF-{Amide} | [Nle5;Asp10,28;Pra13;Leu26]GpTx-1(1-34) | 1907 |
| DCLGVMRKCDPD[Pra]DKCCRPNLVCSRLHDWCKYVF-{Amide} | [Val5;Asp10,28;Pra13;Leu26]GpTx-1(1-34) | 1908 |
| DCLGLMRKCDPD[Pra]DKCCRPNLVCSRLHDWCKYVF-{Amide} | [Leu5,26;Asp10,28;Pra13]GpTx-1(1-34) | 1909 |
| DCLGIMRKCDPD[Pra]DKCCRPNLVCSRLHDWCKYVF-{Amide} | [Ile5;Asp10,28;Pra13;Leu26]GpTx-1(1-34) | 1910 |
| DCLGGFRKCIPD[Pra]DKCCRPNLVCSRLHDWCKYVF-{Amide} | [Gly5;Phe6;Pra13;Leu26;Asp28]GpTx-1(1-34) | 1911 |
| DCLGAFRKCIPD[Pra]DKCCRPNLVCSRLHDWCKYVF-{Amide} | [Ala5;Phe6;Pra13;Leu26;Asp28]GpTx-1(1-34) | 1912 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[2-Abu]FRKCIPD[Pra]DKCCRPNLVCSRLHDWCKYVF-{Amide} | [2-Abu5;Phe6;Pra13;Leu26;Asp28]GpTx-1(1-34) | 1913 |
| DCLG[Nva]FRKCIPD[Pra]DKCCRPNLVCSRLHDWCKYVF-{Amide} | [Nva5;Phe6;Pra13;Leu26;Asp28]GpTx-1(1-34) | 1914 |
| DCLG[Nle]FRKCIPD[Pra]DKCCRPNLVCSRLHDWCKYVF-{Amide} | [Nle5;Phe6;Pra13;Leu26;Asp28]GpTx-1(1-34) | 1915 |
| DCLGVFRKCIPD[Pra]DKCCRPNLVCSRLHDWCKYVF-{Amide} | [Val5;Phe6;Pra13;Leu26;Asp28]GpTx-1(1-34) | 1916 |
| DCLGLFRKCIPD[Pra]DKCCRPNLVCSRLHDWCKYVF-{Amide} | [Leu5,26;Phe6;Pra13;Asp28]GpTx-1(1-34) | 1917 |
| DCLGIFRKCIPD[Pra]DKCCRPNLVCSRLHDWCKYVF-{Amide} | [Ile5;Phe6;Pra13;Leu26;Asp28]GpTx-1(1-34) | 1918 |
| DCLGGLRKCIPD[Pra]DKCCRPNLVCSRLHDWCKYVF-{Amide} | [Gly5;Leu6,26;Pra13;Asp28]GpTx-1(1-34) | 1919 |
| DCLGALRKCIPD[Pra]DKCCRPNLVCSRLHDWCKYVF-{Amide} | [Ala5;Leu6,26;Pra13;Asp28]GpTx-1(1-34) | 1920 |
| DCLG[2-Abu]LRKCIPD[Pra]DKCCRPNLVCSRLHDWCKYVF-{Amide} | [2-Abu5;Leu6,26;Pra13;Asp28]GpTx-1(1-34) | 1921 |
| DCLG[Nva]LRKCIPD[Pra]DKCCRPNLVCSRLHDWCKYVF-{Amide} | [Nva5;Leu6,26;Pra13;Asp28]GpTx-1(1-34) | 1922 |
| DCLG[Nle]LRKCIPD[Pra]DKCCRPNLVCSRLHDWCKYVF-{Amide} | [Nle5;Leu6,26;Pra13;Asp28]GpTx-1(1-34) | 1923 |
| DCLGVLRKCIPD[Pra]DKCCRPNLVCSRLHDWCKYVF-{Amide} | [Val5;Leu6,26;Pra13;Asp28]GpTx-1(1-34) | 1924 |
| DCLGLLRKCIPD[Pra]DKCCRPNLVCSRLHDWCKYVF-{Amide} | [Leu5,6,26;Pra13;Asp28]GpTx-1(1-34) | 1925 |
| DCLGILRKCIPD[Pra]DKCCRPNLVCSRLHDWCKYVF-{Amide} | [Ile5;Leu6,26;Pra13;Asp28]GpTx-1(1-34) | 1926 |
| DCLGG[Nle]RKCIPD[Pra]DKCCRPNLVCSRLHDWCKYVF-{Amide} | [Gly5;Nle6;Pra13;Leu26;Asp28]GpTx-1(1-34) | 1927 |
| DCLGA[Nle]RKCIPD[Pra]DKCCRPNLVCSRLHDWCKYVF-{Amide} | [Ala5;Nle6;Pra13;Leu26;Asp28]GpTx-1(1-34) | 1928 |
| DCLG[2-Abu][Nle]RKCIPD[Pra]DKCCRPNLVCSRLHDWCKYVF-{Amide} | [2-Abu5;Nle6;Pra13;Leu26;Asp28]GpTx-1(1-34) | 1929 |
| DCLG[Nva][Nle]RKCIPD[Pra]DKCCRPNLVCSRLHDWCKYVF-{Amide} | [Nva5;Nle6;Pra13;Leu26;Asp28]GpTx-1(1-34) | 1930 |
| DCLG[Nle][Nle]RKCIPD[Pra]DKCCRPNLVCSRLHDWCKYVF-{Amide} | [Nle5,6;Pra13;Leu26;Asp28]GpTx-1(1-34) | 1931 |
| DCLGV[Nle]RKCIPD[Pra]DKCCRPNLVCSRLHDWCKYVF-{Amide} | [Val5;Nle6;Pra13;Leu26;Asp28]GpTx-1(1-34) | 1932 |
| DCLGL[Nle]RKCIPD[Pra]DKCCRPNLVCSRLHDWCKYVF-{Amide} | [Leu5,26;Nle6;Pra13;Asp28]GpTx-1(1-34) | 1933 |
| DCLGI[Nle]RKCIPD[Pra]DKCCRPNLVCSRLHDWCKYVF-{Amide} | [Ile5;Nle6;Pra13;Leu26;Asp28]GpTx-1(1-34) | 1934 |
| DCLGGFRKCIED[2-Abu]DKCCRPNLVCSRTHDWCKYVF-{Amide} | [Gly5;Phe6;Glu11;2-Abu13;Asp28]GpTx-1(1-34) | 1935 |
| DCLGAFRKCIED[2-Abu]DKCCRPNLVCSRTHDWCKYVF-{Amide} | [Ala5;Phe6;Glu11;2-Abu13;Asp28]GpTx-1(1-34) | 1936 |
| DCLG[2-Abu]FRKCIED[2-Abu]DKCCRPNLVCSRTHDWCKYVF-{Amide} | [2-Abu5,13;Phe6;Glu11;Asp28]GpTx-1(1-34) | 1937 |
| DCLG[Nva]FRKCIED[2-Abu]DKCCRPNLVCSRTHDWCKYVF-{Amide} | [Nva5;Phe6;Glu11;2-Abu13;Asp28]GpTx-1(1-34) | 1938 |
| DCLG[Nle]FRKCIED[2-Abu]DKCCRPNLVCSRTHDWCKYVF-{Amide} | [Nle5;Phe6;Glu11;2-Abu13;Asp28]GpTx-1(1-34) | 1939 |
| DCLGVFRKCIED[2-Abu]DKCCRPNLVCSRTHDWCKYVF-{Amide} | [Val5;Phe6;Glu11;2-Abu13;Asp28]GpTx-1(1-34) | 1940 |
| DCLGLFRKCIED[2-Abu]DKCCRPNLVCSRTHDWCKYVF-{Amide} | [Leu5;Phe6;Glu11;2-Abu13;Asp28]GpTx-1(1-34) | 1941 |
| DCLGIFRKCIED[2-Abu]DKCCRPNLVCSRTHDWCKYVF-{Amide} | [Ile5;Phe6;Glu11;2-Abu13;Asp28]GpTx-1(1-34) | 1942 |
| DCLGGLRKCIED[2-Abu]DKCCRPNLVCSRTHDWCKYVF-{Amide} | [Gly5;Leu6;Glu11;2-Abu13;Asp28]GpTx-1(1-34) | 1943 |
| DCLGALRKCIED[2-Abu]DKCCRPNLVCSRTHDWCKYVF-{Amide} | [Ala5;Leu6;Glu11;2-Abu13;Asp28]GpTx-1(1-34) | 1944 |
| DCLG[2-Abu]LRKCIED[2-Abu]DKCCRPNLVCSRTHDWCKYVF-{Amide} | [2-Abu5,13;Leu6;Glu11;Asp28]GpTx-1(1-34) | 1945 |
| DCLG[Nva]LRKCIED[2-Abu]DKCCRPNLVCSRTHDWCKYVF-{Amide} | [Nva5;Leu6;Glu11;2-Abu13;Asp28]GpTx-1(1-34) | 1946 |
| DCLG[Nle]LRKCIED[2-Abu]DKCCRPNLVCSRTHDWCKYVF-{Amide} | [Nle5;Leu6;Glu11;2-Abu13;Asp28]GpTx-1(1-34) | 1947 |
| DCLGVLRKCIED[2-Abu]DKCCRPNLVCSRTHDWCKYVF-{Amide} | [Val5;Leu6;Glu11;2-Abu13;Asp28]GpTx-1(1-34) | 1948 |
| DCLGLLRKCIED[2-Abu]DKCCRPNLVCSRTHDWCKYVF-{Amide} | [Leu5,6;Glu11;2-Abu13;Asp28]GpTx-1(1-34) | 1949 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGILRKCIED[2-Abu]DKCCRPNLVCSRTHDWCKYVF-{Amide} | [Ile5;Leu6;Glu11;2-Abu13;Asp28]GpTx-1(1-34) | 1950 |
| DCLGG[Nle]RKCIED[2-Abu]DKCCRPNLVCSRTHDWCKYVF-{Amide} | [Gly5;Nle6;Glu11;2-Abu13;Asp28]GpTx-1(1-34) | 1951 |
| DCLGA[Nle]RKCIED[2-Abu]DKCCRPNLVCSRTHDWCKYVF-{Amide} | [Ala5;Nle6;Glu11;2-Abu13;Asp28]GpTx-1(1-34) | 1952 |
| DCLG[2-Abu][Nle]RKCIED[2-Abu]DKCCRPNLVCSRTHDWCKYVF-{Amide} | [2-Abu5,13;Nle6;Glu11;Asp28]GpTx-1(1-34) | 1953 |
| DCLG[Nva][Nle]RKCIED[2-Abu]DKCCRPNLVCSRTHDWCKYVF-{Amide} | [Nva5;Nle6;Glu11;2-Abu13;Asp28]GpTx-1(1-34) | 1954 |
| DCLG[Nle][Nle]RKCIED[2-Abu]DKCCRPNLVCSRTHDWCKYVF-{Amide} | [Nle5,6;Glu11;2-Abu13;Asp28]GpTx-1(1-34) | 1955 |
| DCLGV[Nle]RKCIED[2-Abu]DKCCRPNLVCSRTHDWCKYVF-{Amide} | [Val5;Nle6;Glu11;2-Abu13;Asp28]GpTx-1(1-34) | 1956 |
| DCLGL[Nle]RKCIED[2-Abu]DKCCRPNLVCSRTHDWCKYVF-{Amide} | [Leu5;Nle6;Glu11;2-Abu13;Asp28]GpTx-1(1-34) | 1957 |
| DCLGI[Nle]RKCIED[2-Abu]DKCCRPNLVCSRTHDWCKYVF-{Amide} | [Ile5;Nle6;Glu11;2-Abu13;Asp28]GpTx-1(1-34) | 1958 |
| DCLGGFRKCEPD[2-Abu]DKCCRPNLVCSRTHDWCKYVF-{Amide} | [Gly5;Phe6;Glu10;2-Abu13;Asp28]GpTx-1(1-34) | 1959 |
| DCLGAFRKCEPD[2-Abu]DKCCRPNLVCSRTHDWCKYVF-{Amide} | [Ala5;Phe6;Glu10;2-Abu13;Asp28]GpTx-1(1-34) | 1960 |
| DCLG[2-Abu]FRKCEPD[2-Abu]DKCCRPNLVCSRTHDWCKYVF-{Amide} | [2-Abu5,13;Phe6;Glu10;Asp28]GpTx-1(1-34) | 1961 |
| DCLG[Nva]FRKCEPD[2-Abu]DKCCRPNLVCSRTHDWCKYVF-{Amide} | [Nva5;Phe6;Glu10;2-Abu13;Asp28]GpTx-1(1-34) | 1962 |
| DCLG[Nle]FRKCEPD[2-Abu]DKCCRPNLVCSRTHDWCKYVF-{Amide} | [Nle5;Phe6;Glu10;2-Abu13;Asp28]GpTx-1(1-34) | 1963 |
| DCLGVFRKCEPD[2-Abu]DKCCRPNLVCSRTHDWCKYVF-{Amide} | [Val5;Phe6;Glu10;2-Abu13;Asp28]GpTx-1(1-34) | 1964 |
| DCLGLFRKCEPD[2-Abu]DKCCRPNLVCSRTHDWCKYVF-{Amide} | [Leu5;Phe6;Glu10;2-Abu13;Asp28]GpTx-1(1-34) | 1965 |
| DCLGIFRKCEPD[2-Abu]DKCCRPNLVCSRTHDWCKYVF-{Amide} | [Ile5;Phe6;Glu10;2-Abu13;Asp28]GpTx-1(1-34) | 1966 |
| DCLGGLRKCEPD[2-Abu]DKCCRPNLVCSRTHDWCKYVF-{Amide} | [Gly5;Leu6;Glu10;2-Abu13;Asp28]GpTx-1(1-34) | 1967 |
| DCLGALRKCEPD[2-Abu]DKCCRPNLVCSRTHDWCKYVF-{Amide} | [Ala5;Leu6;Glu10;2-Abu13;Asp28]GpTx-1(1-34) | 1968 |
| DCLG[2-Abu]LRKCEPD[2-Abu]DKCCRPNLVCSRTHDWCKYVF-{Amide} | [2-Abu5,13;Leu6;Glu10;Asp28]GpTx-1(1-34) | 1969 |
| DCLG[Nva]LRKCEPD[2-Abu]DKCCRPNLVCSRTHDWCKYVF-{Amide} | [Nva5;Leu6;Glu10;2-Abu13;Asp28]GpTx-1(1-34) | 1970 |
| DCLG[Nle]LRKCEPD[2-Abu]DKCCRPNLVCSRTHDWCKYVF-{Amide} | [Nle5;Leu6;Glu10;2-Abu13;Asp28]GpTx-1(1-34) | 1971 |
| DCLGVLRKCEPD[2-Abu]DKCCRPNLVCSRTHDWCKYVF-{Amide} | [Val5;Leu6;Glu10;2-Abu13;Asp28]GpTx-1(1-34) | 1972 |
| DCLGLLRKCEPD[2-Abu]DKCCRPNLVCSRTHDWCKYVF-{Amide} | [Leu5,6;Glu10;2-Abu13;Asp28]GpTx-1(1-34) | 1973 |
| DCLGILRKCEPD[2-Abu]DKCCRPNLVCSRTHDWCKYVF-{Amide} | [Ile5;Leu6;Glu10;2-Abu13;Asp28]GpTx-1(1-34) | 1974 |
| DCLGG[Nle]RKCEPD[2-Abu]DKCCRPNLVCSRTHDWCKYVF-{Amide} | [Gly5;Nle6;Glu10;2-Abu13;Asp28]GpTx-1(1-34) | 1975 |
| DCLGA[Nle]RKCEPD[2-Abu]DKCCRPNLVCSRTHDWCKYVF-{Amide} | [Ala5;Nle6;Glu10;2-Abu13;Asp28]GpTx-1(1-34) | 1976 |
| DCLG[2-Abu][Nle]RKCEPD[2-Abu]DKCCRPNLVCSRTHDWCKYVF-{Amide} | [2-Abu5,13;Nle6;Glu10;Asp28]GpTx-1(1-34) | 1977 |
| DCLG[Nva][Nle]RKCEPD[2-Abu]DKCCRPNLVCSRTHDWCKYVF-{Amide} | [Nva5;Nle6;Glu10;2-Abu13;Asp28]GpTx-1(1-34) | 1978 |
| DCLG[Nle][Nle]RKCEPD[2-Abu]DKCCRPNLVCSRTHDWCKYVF-{Amide} | [Nle5,6;Glu10;2-Abu13;Asp28]GpTx-1(1-34) | 1979 |
| DCLGV[Nle]RKCEPD[2-Abu]DKCCRPNLVCSRTHDWCKYVF-{Amide} | [Val5;Nle6;Glu10;2-Abu13;Asp28]GpTx-1(1-34) | 1980 |
| DCLGL[Nle]RKCEPD[2-Abu]DKCCRPNLVCSRTHDWCKYVF-{Amide} | [Leu5;Nle6;Glu10;2-Abu13;Asp28]GpTx-1(1-34) | 1981 |
| DCLGI[Nle]RKCEPD[2-Abu]DKCCRPNLVCSRTHDWCKYVF-{Amide} | [Ile5;Nle6;Glu10;2-Abu13;Asp28]GpTx-1(1-34) | 1982 |
| DCLGGFRKCDPD[2-Abu]DKCCRPNLVCSRTHDWCKYVF-{Amide} | [Gly5;Phe6;Asp10,28;2-Abu13]GpTx-1(1-34) | 1983 |

TABLE 5B-continued

| Amino Acid Sequence | Designation | SEQ ID NO. |
|---|---|---|
| Amino acid sequences of GpTx-1 and GpTx-1 peptide analogs. -{Amide} = amidated C-terminal. | | |
| DCLGAFRKCDPD[2-Abu]DKCCRPNLVCSRTHDWCKYVF-{Amide} | [Ala5;Phe6;Asp10,28;2-Abu13]GpTx-1(1-34) | 1984 |
| DCLG[2-Abu]FRKCDPD[2-Abu]DKCCRPNLVCSRTHDWCKYVF-{Amide} | [2-Abu5,13;Phe6;Asp10,28]GpTx-1(1-34) | 1985 |
| DCLG[Nva]FRKCDPD[2-Abu]DKCCRPNLVCSRTHDWCKYVF-{Amide} | [Nva5;Phe6;Asp10,28;2-Abu13]GpTx-1(1-34) | 1986 |
| DCLG[Nle]FRKCDPD[2-Abu]DKCCRPNLVCSRTHDWCKYVF-{Amide} | [Nle5;Phe6;Asp10,28;2-Abu13]GpTx-1(1-34) | 1987 |
| DCLGVFRKCDPD[2-Abu]DKCCRPNLVCSRTHDWCKYVF-{Amide} | [Val5;Phe6;Asp10,28;2-Abu13]GpTx-1(1-34) | 1988 |
| DCLGLFRKCDPD[2-Abu]DKCCRPNLVCSRTHDWCKYVF-{Amide} | [Leu5;Phe6;Asp10,28;2-Abu13]GpTx-1(1-34) | 1989 |
| DCLGIFRKCDPD[2-Abu]DKCCRPNLVCSRTHDWCKYVF-{Amide} | [Ile5;Phe6;Asp10,28;2-Abu13]GpTx-1(1-34) | 1990 |
| DCLGGLRKCDPD[2-Abu]DKCCRPNLVCSRTHDWCKYVF-{Amide} | [Gly5;Leu6;Asp10,28;2-Abu13]GpTx-1(1-34) | 1991 |
| DCLGALRKCDPD[2-Abu]DKCCRPNLVCSRTHDWCKYVF-{Amide} | [Ala5;Leu6;Asp10,28;2-Abu13]GpTx-1(1-34) | 1992 |
| DCLG[2-Abu]LRKCDPD[2-Abu]DKCCRPNLVCSRTHDWCKYVF-{Amide} | [2-Abu5,13;Leu6;Asp10,28]GpTx-1(1-34) | 1993 |
| DCLG[Nva]LRKCDPD[2-Abu]DKCCRPNLVCSRTHDWCKYVF-{Amide} | [Nva5;Leu6;Asp10,28;2-Abu13]GpTx-1(1-34) | 1994 |
| DCLG[Nle]LRKCDPD[2-Abu]DKCCRPNLVCSRTHDWCKYVF-{Amide} | [Nle5;Leu6;Asp10,28;2-Abu13]GpTx-1(1-34) | 1995 |
| DCLGVLRKCDPD[2-Abu]DKCCRPNLVCSRTHDWCKYVF-{Amide} | [Val5;Leu6;Asp10,28;2-Abu13]GpTx-1(1-34) | 1996 |
| DCLGLLRKCDPD[2-Abu]DKCCRPNLVCSRTHDWCKYVF-{Amide} | [Leu5,6;Asp10,28;2-Abu13]GpTx-1(1-34) | 1997 |
| DCLGILRKCDPD[2-Abu]DKCCRPNLVCSRTHDWCKYVF-{Amide} | [Ile5;Leu6;Asp10,28;2-Abu13]GpTx-1(1-34) | 1998 |
| DCLGG[Nle]RKCDPD[2-Abu]DKCCRPNLVCSRTHDWCKYVF-{Amide} | [Gly5;Nle6;Asp10,28;2-Abu13]GpTx-1(1-34) | 1999 |
| DCLGA[Nle]RKCDPD[2-Abu]DKCCRPNLVCSRTHDWCKYVF-{Amide} | [Ala5;Nle6;Asp10,28;2-Abu13]GpTx-1(1-34) | 2000 |
| DCLG[2-Abu][Nle]RKCDPD[2-Abu]DKCCRPNLVCSRTHDWCKYVF-{Amide} | [2-Abu5,13;Nle6;Asp10,28]GpTx-1(1-34) | 2001 |
| DCLG[Nva][Nle]RKCDPD[2-Abu]DKCCRPNLVCSRTHDWCKYVF-{Amide} | [Nva5;Nle6;Asp10,28;2-Abu13]GpTx-1(1-34) | 2002 |
| DCLG[Nle][Nle]RKCDPD[2-Abu]DKCCRPNLVCSRTHDWCKYVF-{Amide} | [Nle5,6;Asp10,28;2-Abu13]GpTx-1(1-34) | 2003 |
| DCLGV[Nle]RKCDPD[2-Abu]DKCCRPNLVCSRTHDWCKYVF-{Amide} | [Val5;Nle6;Asp10,28;2-Abu13]GpTx-1(1-34) | 2004 |
| DCLGL[Nle]RKCDPD[2-Abu]DKCCRPNLVCSRTHDWCKYVF-{Amide} | [Leu5;Nle6;Asp10,28;2-Abu13]GpTx-1(1-34) | 2005 |
| DCLGI[Nle]RKCDPD[2-Abu]DKCCRPNLVCSRTHDWCKYVF-{Amide} | [Ile5;Nle6;Asp10,28;2-Abu13]GpTx-1(1-34) | 2006 |
| DCLGGFRKCIED[Pra]DKCCRPNLVCSRTHDWCKYVF-{Amide} | [Gly5;Phe6;Glu11;Pra13;Asp28]GpTx-1(1-34) | 2007 |
| DCLGAFRKCIED[Pra]DKCCRPNLVCSRTHDWCKYVF-{Amide} | [Ala5;Phe6;Glu11;Pra13;Asp28]GpTx-1(1-34) | 2008 |
| DCLG[2-Abu]FRKCIED[Pra]DKCCRPNLVCSRTHDWCKYVF-{Amide} | [2-Abu5;Phe6;Glu11;Pra13;Asp28]GpTx-1(1-34) | 2009 |
| DCLG[Nva]FRKCIED[Pra]DKCCRPNLVCSRTHDWCKYVF-{Amide} | [Nva5;Phe6;Glu11;Pra13;Asp28]GpTx-1(1-34) | 2010 |
| DCLG[Nle]FRKCIED[Pra]DKCCRPNLVCSRTHDWCKYVF-{Amide} | [Nle5;Phe6;Glu11;Pra13;Asp28]GpTx-1(1-34) | 2011 |
| DCLGVFRKCIED[Pra]DKCCRPNLVCSRTHDWCKYVF-{Amide} | [Val5;Phe6;Glu11;Pra13;Asp28]GpTx-1(1-34) | 2012 |
| DCLGLFRKCIED[Pra]DKCCRPNLVCSRTHDWCKYVF-{Amide} | [Leu5;Phe6;Glu11;Pra13;Asp28]GpTx-1(1-34) | 2013 |
| DCLGIFRKCIED[Pra]DKCCRPNLVCSRTHDWCKYVF-{Amide} | [Ile5;Phe6;Glu11;Pra13;Asp28]GpTx-1(1-34) | 2014 |
| DCLGGLRKCIED[Pra]DKCCRPNLVCSRTHDWCKYVF-{Amide} | [Gly5;Leu6;Glu11;Pra13;Asp28]GpTx-1(1-34) | 2015 |
| DCLGALRKCIED[Pra]DKCCRPNLVCSRTHDWCKYVF-{Amide} | [Ala5;Leu6;Glu11;Pra13;Asp28]GpTx-1(1-34) | 2016 |
| DCLG[2-Abu]LRKCIED[Pra]DKCCRPNLVCSRTHDWCKYVF-{Amide} | [2-Abu5;Leu6;Glu11;Pra13;Asp28]GpTx-1(1-34) | 2017 |
| DCLG[Nva]LRKCIED[Pra]DKCCRPNLVCSRTHDWCKYVF-{Amide} | [Nva5;Leu6;Glu11;Pra13;Asp28]GpTx-1(1-34) | 2018 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nle]LRKCIED[Pra]DKCCRPNLVCSRTHDWCKYVF-{Amide} | [Nle5;Leu6;Glu11;Pra13;Asp28]GpTx-1(1-34) | 2019 |
| DCLGVLRKCIED[Pra]DKCCRPNLVCSRTHDWCKYVF-{Amide} | [Val5;Leu6;Glu11;Pra13;Asp28]GpTx-1(1-34) | 2020 |
| DCLGLLRKCIED[Pra]DKCCRPNLVCSRTHDWCKYVF-{Amide} | [Leu5,6;Glu11;Pra13;Asp28]GpTx-1(1-34) | 2021 |
| DCLGILRKCIED[Pra]DKCCRPNLVCSRTHDWCKYVF-{Amide} | [Ile5;Leu6;Glu11;Pra13;Asp28]GpTx-1(1-34) | 2022 |
| DCLGG[Nle]RKCIED[Pra]DKCCRPNLVCSRTHDWCKYVF-{Amide} | [Gly5;Nle6;Glu11;Pra13;Asp28]GpTx-1(1-34) | 2023 |
| DCLGA[Nle]RKCIED[Pra]DKCCRPNLVCSRTHDWCKYVF-{Amide} | [Ala5;Nle6;Glu11;Pra13;Asp28]GpTx-1(1-34) | 2024 |
| DCLG[2-Abu][Nle]RKCIED[Pra]DKCCRPNLVCSRTHDWCKYVF-{Amide} | [2-Abu5;Nle6;Glu11;Pra13;Asp28]GpTx-1(1-34) | 2025 |
| DCLG[Nva][Nle]RKCIED[Pra]DKCCRPNLVCSRTHDWCKYVF-{Amide} | [Nva5;Nle6;Glu11;Pra13;Asp28]GpTx-1(1-34) | 2026 |
| DCLG[Nle][Nle]RKCIED[Pra]DKCCRPNLVCSRTHDWCKYVF-{Amide} | [Nle5,6;Glu11;Pra13;Asp28]GpTx-1(1-34) | 2027 |
| DCLGV[Nle]RKCIED[Pra]DKCCRPNLVCSRTHDWCKYVF-{Amide} | [Val5;Nle6;Glu11;Pra13;Asp28]GpTx-1(1-34) | 2028 |
| DCLGL[Nle]RKCIED[Pra]DKCCRPNLVCSRTHDWCKYVF-{Amide} | [Leu5;Nle6;Glu11;Pra13;Asp28]GpTx-1(1-34) | 2029 |
| DCLGI[Nle]RKCIED[Pra]DKCCRPNLVCSRTHDWCKYVF-{Amide} | [Ile5;Nle6;Glu11;Pra13;Asp28]GpTx-1(1-34) | 2030 |
| DCLGGFRKCEPD[Pra]DKCCRPNLVCSRTHDWCKYVF-{Amide} | [Gly5;Phe6;Glu10;Pra13;Asp28]GpTx-1(1-34) | 2031 |
| DCLGAFRKCEPD[Pra]DKCCRPNLVCSRTHDWCKYVF-{Amide} | [Ala5;Phe6;Glu10;Pra13;Asp28]GpTx-1(1-34) | 2032 |
| DCLG[2-Abu]FRKCEPD[Pra]DKCCRPNLVCSRTHDWCKYVF-{Amide} | [2-Abu5;Phe6;Glu10;Pra13;Asp28]GpTx-1(1-34) | 2033 |
| DCLG[Nva]FRKCEPD[Pra]DKCCRPNLVCSRTHDWCKYVF-{Amide} | [Nva5;Phe6;Glu10;Pra13;Asp28]GpTx-1(1-34) | 2034 |
| DCLG[Nle]FRKCEPD[Pra]DKCCRPNLVCSRTHDWCKYVF-{Amide} | [Nle5;Phe6;Glu10;Pra13;Asp28]GpTx-1(1-34) | 2035 |
| DCLGVFRKCEPD[Pra]DKCCRPNLVCSRTHDWCKYVF-{Amide} | [Val5;Phe6;Glu10;Pra13;Asp28]GpTx-1(1-34) | 2036 |
| DCLGLFRKCEPD[Pra]DKCCRPNLVCSRTHDWCKYVF-{Amide} | [Leu5;Phe6;Glu10;Pra13;Asp28]GpTx-1(1-34) | 2037 |
| DCLGIFRKCEPD[Pra]DKCCRPNLVCSRTHDWCKYVF-{Amide} | [Ile5;Phe6;Glu10;Pra13;Asp28]GpTx-1(1-34) | 2038 |
| DCLGGLRKCEPD[Pra]DKCCRPNLVCSRTHDWCKYVF-{Amide} | [Gly5;Leu6;Glu10;Pra13;Asp28]GpTx-1(1-34) | 2039 |
| DCLGALRKCEPD[Pra]DKCCRPNLVCSRTHDWCKYVF-{Amide} | [Ala5;Leu6;Glu10;Pra13;Asp28]GpTx-1(1-34) | 2040 |
| DCLG[2-Abu]LRKCEPD[Pra]DKCCRPNLVCSRTHDWCKYVF-{Amide} | [2-Abu5;Leu6;Glu10;Pra13;Asp28]GpTx-1(1-34) | 2041 |
| DCLG[Nva]LRKCEPD[Pra]DKCCRPNLVCSRTHDWCKYVF-{Amide} | [Nva5;Leu6;Glu10;Pra13;Asp28]GpTx-1(1-34) | 2042 |
| DCLG[Nle]LRKCEPD[Pra]DKCCRPNLVCSRTHDWCKYVF-{Amide} | [Nle5;Leu6;Glu10;Pra13;Asp28]GpTx-1(1-34) | 2043 |
| DCLGVLRKCEPD[Pra]DKCCRPNLVCSRTHDWCKYVF-{Amide} | [Val5;Leu6;Glu10;Pra13;Asp28]GpTx-1(1-34) | 2044 |
| DCLGLLRKCEPD[Pra]DKCCRPNLVCSRTHDWCKYVF-{Amide} | [Leu5,6;Glu10;Pra13;Asp28]GpTx-1(1-34) | 2045 |
| DCLGILRKCEPD[Pra]DKCCRPNLVCSRTHDWCKYVF-{Amide} | [Ile5;Leu6;Glu10;Pra13;Asp28]GpTx-1(1-34) | 2046 |
| DCLGG[Nle]RKCEPD[Pra]DKCCRPNLVCSRTHDWCKYVF-{Amide} | [Gly5;Nle6;Glu10;Pra13;Asp28]GpTx-1(1-34) | 2047 |
| DCLGA[Nle]RKCEPD[Pra]DKCCRPNLVCSRTHDWCKYVF-{Amide} | [Ala5;Nle6;Glu10;Pra13;Asp28]GpTx-1(1-34) | 2048 |
| DCLG[2-Abu][Nle]RKCEPD[Pra]DKCCRPNLVCSRTHDWCKYVF-{Amide} | [2-Abu5;Nle6;Glu10;Pra13;Asp28]GpTx-1(1-34) | 2049 |
| DCLG[Nva][Nle]RKCEPD[Pra]DKCCRPNLVCSRTHDWCKYVF-{Amide} | [Nva5;Nle6;Glu10;Pra13;Asp28]GpTx-1(1-34) | 2050 |
| DCLG[Nle][Nle]RKCEPD[Pra]DKCCRPNLVCSRTHDWCKYVF-{Amide} | [Nle5,6;Glu10;Pra13;Asp28]GpTx-1(1-34) | 2051 |
| DCLGV[Nle]RKCEPD[Pra]DKCCRPNLVCSRTHDWCKYVF-{Amide} | [Val5;Nle6;Glu10;Pra13;Asp28]GpTx-1(1-34) | 2052 |
| DCLGL[Nle]RKCEPD[Pra]DKCCRPNLVCSRTHDWCKYVF-{Amide} | [Leu5;Nle6;Glu10;Pra13;Asp28]GpTx-1(1-34) | 2053 |
| DCLGI[Nle]RKCEPD[Pra]DKCCRPNLVCSRTHDWCKYVF-{Amide} | [Ile5;Nle6;Glu10;Pra13;Asp28]GpTx-1(1-34) | 2054 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGFRKCDPD[Pra]DKCCRPNLVCSRTHDWCKYVF-{Amide} | [Gly5;Phe6;Asp10,28;Pra13]GpTx-1(1-34) | 2055 |
| DCLGAFRKCDPD[Pra]DKCCRPNLVCSRTHDWCKYVF-{Amide} | [Ala5;Phe6;Asp10,28;Pra13]GpTx-1(1-34) | 2056 |
| DCLG[2-Abu]FRKCDPD[Pra]DKCCRPNLVCSRTHDWCKYVF-{Amide} | [2-Abu5;Phe6;Asp10,28;Pra13]GpTx-1(1-34) | 2057 |
| DCLG[Nva]FRKCDPD[Pra]DKCCRPNLVCSRTHDWCKYVF-{Amide} | [Nva5;Phe6;Asp10,28;Pra13]GpTx-1(1-34) | 2058 |
| DCLG[Nle]FRKCDPD[Pra]DKCCRPNLVCSRTHDWCKYVF-{Amide} | [Nle5;Phe6;Asp10,28;Pra13]GpTx-1(1-34) | 2059 |
| DCLGVFRKCDPD[Pra]DKCCRPNLVCSRTHDWCKYVF-{Amide} | [Val5;Phe6;Asp10,28;Pra13]GpTx-1(1-34) | 2060 |
| DCLGLFRKCDPD[Pra]DKCCRPNLVCSRTHDWCKYVF-{Amide} | [Leu5;Phe6;Asp10,28;Pra13]GpTx-1(1-34) | 2061 |
| DCLGIFRKCDPD[Pra]DKCCRPNLVCSRTHDWCKYVF-{Amide} | [Ile5;Phe6;Asp10,28;Pra13]GpTx-1(1-34) | 2062 |
| DCLGGLRKCDPD[Pra]DKCCRPNLVCSRTHDWCKYVF-{Amide} | [Gly5;Leu6;Asp10,28;Pra13]GpTx-1(1-34) | 2063 |
| DCLGALRKCDPD[Pra]DKCCRPNLVCSRTHDWCKYVF-{Amide} | [Ala5;Leu6;Asp10,28;Pra13]GpTx-1(1-34) | 2064 |
| DCLG[2-Abu]LRKCDPD[Pra]DKCCRPNLVCSRTHDWCKYVF-{Amide} | [2-Abu5;Leu6;Asp10,28;Pra13]GpTx-1(1-34) | 2065 |
| DCLG[Nva]LRKCDPD[Pra]DKCCRPNLVCSRTHDWCKYVF-{Amide} | [Nva5;Leu6;Asp10,28;Pra13]GpTx-1(1-34) | 2066 |
| DCLG[Nle]LRKCDPD[Pra]DKCCRPNLVCSRTHDWCKYVF-{Amide} | [Nle5;Leu6;Asp10,28;Pra13]GpTx-1(1-34) | 2067 |
| DCLGVLRKCDPD[Pra]DKCCRPNLVCSRTHDWCKYVF-{Amide} | [Val5;Leu6;Asp10,28;Pra13]GpTx-1(1-34) | 2068 |
| DCLGLLRKCDPD[Pra]DKCCRPNLVCSRTHDWCKYVF-{Amide} | [Leu5,6;Asp10,28;Pra13]GpTx-1(1-34) | 2069 |
| DCLGILRKCDPD[Pra]DKCCRPNLVCSRTHDWCKYVF-{Amide} | [Ile5;Leu6;Asp10,28;Pra13]GpTx-1(1-34) | 2070 |
| DCLGG[Nle]RKCDPD[Pra]DKCCRPNLVCSRTHDWCKYVF-{Amide} | [Gly5;Nle6;Asp10,28;Pra13]GpTx-1(1-34) | 2071 |
| DCLGA[Nle]RKCDPD[Pra]DKCCRPNLVCSRTHDWCKYVF-{Amide} | [Ala5;Nle6;Asp10,28;Pra13]GpTx-1(1-34) | 2072 |
| DCLG[2-Abu][Nle]RKCDPD[Pra]DKCCRPNLVCSRTHDWCKYVF-{Amide} | [2-Abu5;Nle6;Asp10,28;Pra13]GpTx-1(1-34) | 2073 |
| DCLG[Nva][Nle]RKCDPD[Pra]DKCCRPNLVCSRTHDWCKYVF-{Amide} | [Nva5;Nle6;Asp10,28;Pra13]GpTx-1(1-34) | 2074 |
| DCLG[Nle][Nle]RKCDPD[Pra]DKCCRPNLVCSRTHDWCKYVF-{Amide} | [Nle5,6;Asp10,28;Pra13]GpTx-1(1-34) | 2075 |
| DCLGV[Nle]RKCDPD[Pra]DKCCRPNLVCSRTHDWCKYVF-{Amide} | [Val5;Nle6;Asp10,28;Pra13]GpTx-1(1-34) | 2076 |
| DCLGL[Nle]RKCDPD[Pra]DKCCRPNLVCSRTHDWCKYVF-{Amide} | [Leu5;Nle6;Asp10,28;Pra13]GpTx-1(1-34) | 2077 |
| DCLGI[Nle]RKCDPD[Pra]DKCCRPNLVCSRTHDWCKYVF-{Amide} | [Ile5;Nle6;Asp10,28;Pra13]GpTx-1(1-34) | 2078 |
| DCLGGFRKCIED[2-Abu]DKCCRPNLVCSRLHDWCKYVF-{Amide} | [Gly5;Phe6;Glu11;2-Abu13;Leu26;Asp28]GpTx-1(1-34) | 2079 |
| DCLGAFRKCIED[2-Abu]DKCCRPNLVCSRLHDWCKYVF-{Amide} | [Ala5;Phe6;Glu11;2-Abu13;Leu26;Asp28]GpTx-1(1-34) | 2080 |
| DCLG[2-Abu]FRKCIED[2-Abu]DKCCRPNLVCSRLHDWCKYVF-{Amide} | [2-Abu5,13;Phe6;Glu11;Leu26;Asp28]GpTx-1(1-34) | 2081 |
| DCLG[Nva]FRKCIED[2-Abu]DKCCRPNLVCSRLHDWCKYVF-{Amide} | [Nva5;Phe6;Glu11;2-Abu13;Leu26;Asp28]GpTx-1(1-34) | 2082 |
| DCLG[Nle]FRKCIED[2-Abu]DKCCRPNLVCSRLHDWCKYVF-{Amide} | [Nle5;Phe6;Glu11;2-Abu13;Leu26;Asp28]GpTx-1(1-34) | 2083 |
| DCLGVFRKCIED[2-Abu]DKCCRPNLVCSRLHDWCKYVF-{Amide} | [Val5;Phe6;Glu11;2-Abu13;Leu26;Asp28]GpTx-1(1-34) | 2084 |
| DCLGLFRKCIED[2-Abu]DKCCRPNLVCSRLHDWCKYVF-{Amide} | [Leu5,26;Phe6;Glu11;2-Abu13;Asp28]GpTx-1(1-34) | 2085 |
| DCLGIFRKCIED[2-Abu]DKCCRPNLVCSRLHDWCKYVF-{Amide} | [Ile5;Phe6;Glu11;2-Abu13;Leu26;Asp28]GpTx-1(1-34) | 2086 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGLRKCIED[2-Abu]DKCCRPNLVCSRLHDWCKYVF-{Amide} | [Gly5;Leu6,26;Glu11;2-Abu13;Asp28]GpTx-1(1-34) | 2087 |
| DCLGALRKCIED[2-Abu]DKCCRPNLVCSRLHDWCKYVF-{Amide} | [Ala5;Leu6,26;Glu11;2-Abu13;Asp28]GpTx-1(1-34) | 2088 |
| DCLG[2-Abu]LRKCIED[2-Abu]DKCCRPNLVCSRLHDWCKYVF-{Amide} | [2-Abu5,13;Leu6,26;Glu11;Asp28]GpTx-1(1-34) | 2089 |
| DCLG[Nva]LRKCIED[2-Abu]DKCCRPNLVCSRLHDWCKYVF-{Amide} | [Nva5;Leu6,26;Glu11;2-Abu13;Asp28]GpTx-1(1-34) | 2090 |
| DCLG[Nle]LRKCIED[2-Abu]DKCCRPNLVCSRLHDWCKYVF-{Amide} | [Nle5;Leu6,26;Glu11;2-Abu13;Asp28]GpTx-1(1-34) | 2091 |
| DCLGVLRKCIED[2-Abu]DKCCRPNLVCSRLHDWCKYVF-{Amide} | [Val5;Leu6,26;Glu11;2-Abu13;Asp28]GpTx-1(1-34) | 2092 |
| DCLGLLRKCIED[2-Abu]DKCCRPNLVCSRLHDWCKYVF-{Amide} | [Leu5,6,26;Glu11;2-Abu13;Asp28]GpTx-1(1-34) | 2093 |
| DCLGILRKCIED[2-Abu]DKCCRPNLVCSRLHDWCKYVF-{Amide} | [Ile5;Leu6,26;Glu11;2-Abu13;Asp28]GpTx-1(1-34) | 2094 |
| DCLGG[Nle]RKCIED[2-Abu]DKCCRPNLVCSRLHDWCKYVF-{Amide} | [Gly5;Nle6;Glu11;2-Abu13;Leu26;Asp28]GpTx-1(1-34) | 2095 |
| DCLGA[Nle]RKCIED[2-Abu]DKCCRPNLVCSRLHDWCKYVF-{Amide} | [Ala5;Nle6;Glu11;2-Abu13;Leu26;Asp28]GpTx-1(1-34) | 2096 |
| DCLG[2-Abu][Nle]RKCIED[2-Abu]DKCCRPNLVCSRLHDWCKYVF-{Amide} | [2-Abu5,13;Nle6;Glu11;Leu26;Asp28]GpTx-1(1-34) | 2097 |
| DCLG[Nva][Nle]RKCIED[2-Abu]DKCCRPNLVCSRLHDWCKYVF-{Amide} | [Nva5;Nle6;Glu11;2-Abu13;Leu26;Asp28]GpTx-1(1-34) | 2098 |
| DCLG[Nle][Nle]RKCIED[2-Abu]DKCCRPNLVCSRLHDWCKYVF-{Amide} | [Nle5,6;Glu11;2-Abu13;Leu26;Asp28]GpTx-1(1-34) | 2099 |
| DCLGV[Nle]RKCIED[2-Abu]DKCCRPNLVCSRLHDWCKYVF-{Amide} | [Val5;Nle6;Glu11;2-Abu13;Leu26;Asp28]GpTx-1(1-34) | 2100 |
| DCLGL[Nle]RKCIED[2-Abu]DKCCRPNLVCSRLHDWCKYVF-{Amide} | [Leu5,26;Nle6;Glu11;2-Abu13;Asp28]GpTx-1(1-34) | 2101 |
| DCLGI[Nle]RKCIED[2-Abu]DKCCRPNLVCSRLHDWCKYVF-{Amide} | [Ile5;Nle6;Glu11;2-Abu13;Leu26;Asp28]GpTx-1(1-34) | 2102 |
| DCLGGFRKCEPD[2-Abu]DKCCRPNLVCSRLHDWCKYVF-{Amide} | [Gly5;Phe6;Glu10;2-Abu13;Leu26;Asp28]GpTx-1(1-34) | 2103 |
| DCLGAFRKCEPD[2-Abu]DKCCRPNLVCSRLHDWCKYVF-{Amide} | [Ala5;Phe6;Glu10;2-Abu13;Leu26;Asp28]GpTx-1(1-34) | 2104 |
| DCLG[2-Abu]FRKCEPD[2-Abu]DKCCRPNLVCSRLHDWCKYVF-{Amide} | [2-Abu5,13;Phe6;Glu10;Leu26;Asp28]GpTx-1(1-34) | 2105 |
| DCLG[Nva]FRKCEPD[2-Abu]DKCCRPNLVCSRLHDWCKYVF-{Amide} | [Nva5;Phe6;Glu10;2-Abu13;Leu26;Asp28]GpTx-1(1-34) | 2106 |
| DCLG[Nle]FRKCEPD[2-Abu]DKCCRPNLVCSRLHDWCKYVF-{Amide} | [Nle5;Phe6;Glu10;2-Abu13;Leu26;Asp28]GpTx-1(1-34) | 2107 |
| DCLGVFRKCEPD[2-Abu]DKCCRPNLVCSRLHDWCKYVF-{Amide} | [Val5;Phe6;Glu10;2-Abu13;Leu26;Asp28]GpTx-1(1-34) | 2108 |
| DCLGLFRKCEPD[2-Abu]DKCCRPNLVCSRLHDWCKYVF-{Amide} | [Leu5,26;Phe6;Glu10;2-Abu13;Asp28]GpTx-1(1-34) | 2109 |
| DCLGIFRKCEPD[2-Abu]DKCCRPNLVCSRLHDWCKYVF-{Amide} | [Ile5;Phe6;Glu10;2-Abu13;Leu26;Asp28]GpTx-1(1-34) | 2110 |
| DCLGGLRKCEPD[2-Abu]DKCCRPNLVCSRLHDWCKYVF-{Amide} | [Gly5;Leu6,26;Glu10;2-Abu13;Asp28]GpTx-1(1-34) | 2111 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGALRKCEPD[2-Abu]DKCCRPNLVCSRLHDWCKYVF-{Amide} | [Ala5;Leu6,26;Glu10;2-Abu13;Asp28]GpTx-1(1-34) | 2112 |
| DCLG[2-Abu]LRKCEPD[2-Abu]DKCCRPNLVCSRLHDWCKYVF-{Amide} | [2-Abu5,13;Leu6,26;Glu10;Asp28]GpTx-1(1-34) | 2113 |
| DCLG[Nva]LRKCEPD[2-Abu]DKCCRPNLVCSRLHDWCKYVF-{Amide} | [Nva5;Leu6,26;Glu10;2-Abu13;Asp28]GpTx-1(1-34) | 2114 |
| DCLG[Nle]LRKCEPD[2-Abu]DKCCRPNLVCSRLHDWCKYVF-{Amide} | [Nle5;Leu6,26;Glu10;2-Abu13;Asp28]GpTx-1(1-34) | 2115 |
| DCLGVLRKCEPD[2-Abu]DKCCRPNLVCSRLHDWCKYVF-{Amide} | [Val5;Leu6,26;Glu10;2-Abu13;Asp28]GpTx-1(1-34) | 2116 |
| DCLGLLRKCEPD[2-Abu]DKCCRPNLVCSRLHDWCKYVF-{Amide} | [Leu5,6,26;Glu10;2-Abu13;Asp28]GpTx-1(1-34) | 2117 |
| DCLGILRKCEPD[2-Abu]DKCCRPNLVCSRLHDWCKYVF-{Amide} | [Ile5;Leu6,26;Glu10;2-Abu13;Asp28]GpTx-1(1-34) | 2118 |
| DCLGG[Nle]RKCEPD[2-Abu]DKCCRPNLVCSRLHDWCKYVF-{Amide} | [Gly5;Nle6;Glu10;2-Abu13;Leu26;Asp28]GpTx-1(1-34) | 2119 |
| DCLGA[Nle]RKCEPD[2-Abu]DKCCRPNLVCSRLHDWCKYVF-{Amide} | [Ala5;Nle6;Glu10;2-Abu13;Leu26;Asp28]GpTx-1(1-34) | 2120 |
| DCLG[2-Abu][Nle]RKCEPD[2-Abu]DKCCRPNLVCSRLHDWCKYVF-{Amide} | [2-Abu5,13;Nle6;Glu10;Leu26;Asp28]GpTx-1(1-34) | 2121 |
| DCLG[Nva][Nle]RKCEPD[2-Abu]DKCCRPNLVCSRLHDWCKYVF-{Amide} | [Nva5;Nle6;Glu10;2-Abu13;Leu26;Asp28]GpTx-1(1-34) | 2122 |
| DCLG[Nle][Nle]RKCEPD[2-Abu]DKCCRPNLVCSRLHDWCKYVF-{Amide} | [Nle5,6;Glu10;2-Abu13;Leu26;Asp28]GpTx-1(1-34) | 2123 |
| DCLGV[Nle]RKCEPD[2-Abu]DKCCRPNLVCSRLHDWCKYVF-{Amide} | [Val5;Nle6;Glu10;2-Abu13;Leu26;Asp28]GpTx-1(1-34) | 2124 |
| DCLGL[Nle]RKCEPD[2-Abu]DKCCRPNLVCSRLHDWCKYVF-{Amide} | [Leu5,26;Nle6;Glu10;2-Abu13;Asp28]GpTx-1(1-34) | 2125 |
| DCLGI[Nle]RKCEPD[2-Abu]DKCCRPNLVCSRLHDWCKYVF-{Amide} | [Ile5;Nle6;Glu10;2-Abu13;Leu26;Asp28]GpTx-1(1-34) | 2126 |
| DCLGGFRKCDPD[2-Abu]DKCCRPNLVCSRLHDWCKYVF-{Amide} | [Gly5;Phe6;Asp10,28;2-Abu13;Leu26]GpTx-1(1-34) | 2127 |
| DCLGAFRKCDPD[2-Abu]DKCCRPNLVCSRLHDWCKYVF-{Amide} | [Ala5;Phe6;Asp10,28;2-Abu13;Leu26]GpTx-1(1-34) | 2128 |
| DCLG[2-Abu]FRKCDPD[2-Abu]DKCCRPNLVCSRLHDWCKYVF-{Amide} | [2-Abu5,13;Phe6;Asp10,28;Leu26]GpTx-1(1-34) | 2129 |
| DCLG[Nva]FRKCDPD[2-Abu]DKCCRPNLVCSRLHDWCKYVF-{Amide} | [Nva5;Phe6;Asp10,28;2-Abu13;Leu26]GpTx-1(1-34) | 2130 |
| DCLG[Nle]FRKCDPD[2-Abu]DKCCRPNLVCSRLHDWCKYVF-{Amide} | [Nle5;Phe6;Asp10,28;2-Abu13;Leu26]GpTx-1(1-34) | 2131 |
| DCLGVFRKCDPD[2-Abu]DKCCRPNLVCSRLHDWCKYVF-{Amide} | [Val5;Phe6;Asp10,28;2-Abu13;Leu26]GpTx-1(1-34) | 2132 |
| DCLGLFRKCDPD[2-Abu]DKCCRPNLVCSRLHDWCKYVF-{Amide} | [Leu5,26;Phe6;Asp10,28;2-Abu13]GpTx-1(1-34) | 2133 |
| DCLGIFRKCDPD[2-Abu]DKCCRPNLVCSRLHDWCKYVF-{Amide} | [Ile5;Phe6;Asp10,28;2-Abu13;Leu26]GpTx-1(1-34) | 2134 |
| DCLGGLRKCDPD[2-Abu]DKCCRPNLVCSRLHDWCKYVF-{Amide} | [Gly5;Leu6,26;Asp10,28;2-Abu13]GpTx-1(1-34) | 2135 |
| DCLGALRKCDPD[2-Abu]DKCCRPNLVCSRLHDWCKYVF-{Amide} | [Ala5;Leu6,26;Asp10,28;2-Abu13]GpTx-1(1-34) | 2136 |
| DCLG[2-Abu]LRKCDPD[2-Abu]DKCCRPNLVCSRLHDWCKYVF-{Amide} | [2-Abu5,13;Leu6,26;Asp10,28]GpTx-1(1-34) | 2137 |
| DCLG[Nva]LRKCDPD[2-Abu]DKCCRPNLVCSRLHDWCKYVF-{Amide} | [Nva5;Leu6,26;Asp10,28;2-Abu13]GpTx-1(1-34) | 2138 |
| DCLG[Nle]LRKCDPD[2-Abu]DKCCRPNLVCSRLHDWCKYVF-{Amide} | [Nle5;Leu6,26;Asp10,28;2-Abu13]GpTx-1(1-34) | 2139 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGVLRKCDPD[2-Abu]DKCCRPNLVCSRLHDWCKYVF-{Amide} | [Val5;Leu6,26;Asp10,28;2-Abu13]GpTx-1(1-34) | 2140 |
| DCLGLLRKCDPD[2-Abu]DKCCRPNLVCSRLHDWCKYVF-{Amide} | [Leu5,6,26;Asp10,28;2-Abu13]GpTx-1(1-34) | 2141 |
| DCLGILRKCDPD[2-Abu]DKCCRPNLVCSRLHDWCKYVF-{Amide} | [Ile5;Leu6,26;Asp10,28;2-Abu13]GpTx-1(1-34) | 2142 |
| DCLGG[Nle]RKCDPD[2-Abu]DKCCRPNLVCSRLHDWCKYVF-{Amide} | [Gly5;Nle6;Asp10,28;2-Abu13;Leu26]GpTx-1(1-34) | 2143 |
| DCLGA[Nle]RKCDPD[2-Abu]DKCCRPNLVCSRLHDWCKYVF-{Amide} | [Ala5;Nle6;Asp10,28;2-Abu13;Leu26]GpTx-1(1-34) | 2144 |
| DCLG[2-Abu][Nle]RKCDPD[2-Abu]DKCCRPNLVCSRLHDWCKYVF-{Amide} | [2-Abu5,13;Nle6;Asp10,28;Leu26]GpTx-1(1-34) | 2145 |
| DCLG[Nva][Nle]RKCDPD[2-Abu]DKCCRPNLVCSRLHDWCKYVF-{Amide} | [Nva5;Nle6;Asp10,28;2-Abu13;Leu26]GpTx-1(1-34) | 2146 |
| DCLG[Nle][Nle]RKCDPD[2-Abu]DKCCRPNLVCSRLHDWCKYVF-{Amide} | [Nle5,6;Asp10,28;2-Abu13;Leu26]GpTx-1(1-34) | 2147 |
| DCLGV[Nle]RKCDPD[2-Abu]DKCCRPNLVCSRLHDWCKYVF-{Amide} | [Val5;Nle6;Asp10,28;2-Abu13;Leu26]GpTx-1(1-34) | 2148 |
| DCLGL[Nle]RKCDPD[2-Abu]DKCCRPNLVCSRLHDWCKYVF-{Amide} | [Leu5,26;Nle6;Asp10,28;2-Abu13]GpTx-1(1-34) | 2149 |
| DCLGI[Nle]RKCDPD[2-Abu]DKCCRPNLVCSRLHDWCKYVF-{Amide} | [Ile5;Nle6;Asp10,28;2-Abu13;Leu26]GpTx-1(1-34) | 2150 |
| DCLGGFRKCIED[Pra]DKCCRPNLVCSRLHDWCKYVF-{Amide} | [Gly5;Phe6;Glu11;Pra13;Leu26;Asp28]GpTx-1(1-34) | 2151 |
| DCLGAFRKCIED[Pra]DKCCRPNLVCSRLHDWCKYVF-{Amide} | [Ala5;Phe6;Glu11;Pra13;Leu26;Asp28]GpTx-1(1-34) | 2152 |
| DCLG[2-Abu]FRKCIED[Pra]DKCCRPNLVCSRLHDWCKYVF-{Amide} | [2-Abu5;Phe6;Glu11;Pra13;Leu26;Asp28]GpTx-1(1-34) | 2153 |
| DCLG[Nva]FRKCIED[Pra]DKCCRPNLVCSRLHDWCKYVF-{Amide} | [Nva5;Phe6;Glu11;Pra13;Leu26;Asp28]GpTx-1(1-34) | 2154 |
| DCLG[Nle]FRKCIED[Pra]DKCCRPNLVCSRLHDWCKYVF-{Amide} | [Nle5;Phe6;Glu11;Pra13;Leu26;Asp28]GpTx-1(1-34) | 2155 |
| DCLGVFRKCIED[Pra]DKCCRPNLVCSRLHDWCKYVF-{Amide} | [Val5;Phe6;Glu11;Pra13;Leu26;Asp28]GpTx-1(1-34) | 2156 |
| DCLGLFRKCIED[Pra]DKCCRPNLVCSRLHDWCKYVF-{Amide} | [Leu5,26;Phe6;Glu11;Pra13;Asp28]GpTx-1(1-34) | 2157 |
| DCLGIFRKCIED[Pra]DKCCRPNLVCSRLHDWCKYVF-{Amide} | [Ile5;Phe6;Glu11;Pra13;Leu26;Asp28]GpTx-1(1-34) | 2158 |
| DCLGGLRKCIED[Pra]DKCCRPNLVCSRLHDWCKYVF-{Amide} | [Gly5;Leu6,26;Glu11;Pra13;Asp28]GpTx-1(1-34) | 2159 |
| DCLGALRKCIED[Pra]DKCCRPNLVCSRLHDWCKYVF-{Amide} | [Ala5;Leu6,26;Glu11;Pra13;Asp28]GpTx-1(1-34) | 2160 |
| DCLG[2-Abu]LRKCIED[Pra]DKCCRPNLVCSRLHDWCKYVF-{Amide} | [2-Abu5;Leu6,26;Glu11;Pra13;Asp28]GpTx-1(1-34) | 2161 |
| DCLG[Nva]LRKCIED[Pra]DKCCRPNLVCSRLHDWCKYVF-{Amide} | [Nva5;Leu6,26;Glu11;Pra13;Asp28]GpTx-1(1-34) | 2162 |
| DCLG[Nle]LRKCIED[Pra]DKCCRPNLVCSRLHDWCKYVF-{Amide} | [Nle5;Leu6,26;Glu11;Pra13;Asp28]GpTx-1(1-34) | 2163 |
| DCLGVLRKCIED[Pra]DKCCRPNLVCSRLHDWCKYVF-{Amide} | [Val5;Leu6,26;Glu11;Pra13;Asp28]GpTx-1(1-34) | 2164 |
| DCLGLLRKCIED[Pra]DKCCRPNLVCSRLHDWCKYVF-{Amide} | [Leu5,6,26;Glu11;Pra13;Asp28]GpTx-1(1-34) | 2165 |
| DCLGILRKCIED[Pra]DKCCRPNLVCSRLHDWCKYVF-{Amide} | [Ile5;Leu6,26;Glu11;Pra13;Asp28]GpTx-1(1-34) | 2166 |
| DCLGG[Nle]RKCIED[Pra]DKCCRPNLVCSRLHDWCKYVF-{Amide} | [Gly5;Nle6;Glu11;Pra13;Leu26;Asp28]GpTx-1(1-34) | 2167 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGA[Nle]RKCIED[Pra]DKCCRPNLVCSRLHDWCKYVF-{Amide} | [Ala5;Nle6;Glu11;Pra13;Leu26;Asp28]GpTx-1(1-34) | 2168 |
| DCLG[2-Abu][Nle]RKCIED[Pra]DKCCRPNLVCSRLHDWCKYVF-{Amide} | [2-Abu5;Nle6;Glu11;Pra13;Leu26;Asp28]GpTx-1(1-34) | 2169 |
| DCLG[Nva][Nle]RKCIED[Pra]DKCCRPNLVCSRLHDWCKYVF-{Amide} | [Nva5;Nle6;Glu11;Pra13;Leu26;Asp28]GpTx-1(1-34) | 2170 |
| DCLG[Nle][Nle]RKCIED[Pra]DKCCRPNLVCSRLHDWCKYVF-{Amide} | [Nle5,6;Glu11;Pra13;Leu26;Asp28]GpTx-1(1-34) | 2171 |
| DCLGV[Nle]RKCIED[Pra]DKCCRPNLVCSRLHDWCKYVF-{Amide} | [Val5;Nle6;Glu11;Pra13;Leu26;Asp28]GpTx-1(1-34) | 2172 |
| DCLGL[Nle]RKCIED[Pra]DKCCRPNLVCSRLHDWCKYVF-{Amide} | [Leu5,26;Nle6;Glu11;Pra13;Asp28]GpTx-1(1-34) | 2173 |
| DCLGI[Nle]RKCIED[Pra]DKCCRPNLVCSRLHDWCKYVF-{Amide} | [Ile5;Nle6;Glu11;Pra13;Leu26;Asp28]GpTx-1(1-34) | 2174 |
| DCLGGFRKCEPD[Pra]DKCCRPNLVCSRLHDWCKYVF-{Amide} | [Gly5;Phe6;Glu10;Pra13;Leu26;Asp28]GpTx-1(1-34) | 2175 |
| DCLGAFRKCEPD[Pra]DKCCRPNLVCSRLHDWCKYVF-{Amide} | [Ala5;Phe6;Glu10;Pra13;Leu26;Asp28]GpTx-1(1-34) | 2176 |
| DCLG[2-Abu]FRKCEPD[Pra]DKCCRPNLVCSRLHDWCKYVF-{Amide} | [2-Abu5;Phe6;Glu10;Pra13;Leu26;Asp28]GpTx-1(1-34) | 2177 |
| DCLG[Nva]FRKCEPD[Pra]DKCCRPNLVCSRLHDWCKYVF-{Amide} | [Nva5;Phe6;Glu10;Pra13;Leu26;Asp28]GpTx-1(1-34) | 2178 |
| DCLG[Nle]FRKCEPD[Pra]DKCCRPNLVCSRLHDWCKYVF-{Amide} | [Nle5;Phe6;Glu10;Pra13;Leu26;Asp28]GpTx-1(1-34) | 2179 |
| DCLGVFRKCEPD[Pra]DKCCRPNLVCSRLHDWCKYVF-{Amide} | [Val5;Phe6;Glu10;Pra13;Leu26;Asp28]GpTx-1(1-34) | 2180 |
| DCLGLFRKCEPD[Pra]DKCCRPNLVCSRLHDWCKYVF-{Amide} | [Leu5,26;Phe6;Glu10;Pra13;Asp28]GpTx-1(1-34) | 2181 |
| DCLGIFRKCEPD[Pra]DKCCRPNLVCSRLHDWCKYVF-{Amide} | [Ile5;Phe6;Glu10;Pra13;Leu26;Asp28]GpTx-1(1-34) | 2182 |
| DCLGGLRKCEPD[Pra]DKCCRPNLVCSRLHDWCKYVF-{Amide} | [Gly5;Leu6,26;Glu10;Pra13;Asp28]GpTx-1(1-34) | 2183 |
| DCLGALRKCEPD[Pra]DKCCRPNLVCSRLHDWCKYVF-{Amide} | [Ala5;Leu6,26;Glu10;Pra13;Asp28]GpTx-1(1-34) | 2184 |
| DCLG[2-Abu]LRKCEPD[Pra]DKCCRPNLVCSRLHDWCKYVF-{Amide} | [2-Abu5;Leu6,26;Glu10;Pra13;Asp28]GpTx-1(1-34) | 2185 |
| DCLG[Nva]LRKCEPD[Pra]DKCCRPNLVCSRLHDWCKYVF-{Amide} | [Nva5;Leu6,26;Glu10;Pra13;Asp28]GpTx-1(1-34) | 2186 |
| DCLG[Nle]LRKCEPD[Pra]DKCCRPNLVCSRLHDWCKYVF-{Amide} | [Nle5;Leu6,26;Glu10;Pra13;Asp28]GpTx-1(1-34) | 2187 |
| DCLGVLRKCEPD[Pra]DKCCRPNLVCSRLHDWCKYVF-{Amide} | [Val5;Leu6,26;Glu10;Pra13;Asp28]GpTx-1(1-34) | 2188 |
| DCLGLLRKCEPD[Pra]DKCCRPNLVCSRLHDWCKYVF-{Amide} | [Leu5,6,26;Glu10;Pra13;Asp28]GpTx-1(1-34) | 2189 |
| DCLGILRKCEPD[Pra]DKCCRPNLVCSRLHDWCKYVF-{Amide} | [Ile5;Leu6,26;Glu10;Pra13;Asp28]GpTx-1(1-34) | 2190 |
| DCLGG[Nle]RKCEPD[Pra]DKCCRPNLVCSRLHDWCKYVF-{Amide} | [Gly5;Nle6;Glu10;Pra13;Leu26;Asp28]GpTx-1(1-34) | 2191 |
| DCLGA[Nle]RKCEPD[Pra]DKCCRPNLVCSRLHDWCKYVF-{Amide} | [Ala5;Nle6;Glu10;Pra13;Leu26;Asp28]GpTx-1(1-34) | 2192 |
| DCLG[2-Abu][Nle]RKCEPD[Pra]DKCCRPNLVCSRLHDWCKYVF-{Amide} | [2-Abu5;Nle6;Glu10;Pra13;Leu26;Asp28]GpTx-1(1-34) | 2193 |
| DCLG[Nva][Nle]RKCEPD[Pra]DKCCRPNLVCSRLHDWCKYVF-{Amide} | [Nva5;Nle6;Glu10;Pra13;Leu26;Asp28]GpTx-1(1-34) | 2194 |
| DCLG[Nle][Nle]RKCEPD[Pra]DKCCRPNLVCSRLHDWCKYVF-{Amide} | [Nle5,6;Glu10;Pra13;Leu26;Asp28]GpTx-1(1-34) | 2195 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGV[Nle]RKCEPD[Pra]DKCCRPNLVCSRLHDWCKYVF-{Amide} | [Val5;Nle6;Glu10;Pra13;Leu26;Asp28]GpTx-1(1-34) | 2196 |
| DCLGL[Nle]RKCEPD[Pra]DKCCRPNLVCSRLHDWCKYVF-{Amide} | [Leu5,26;Nle6;Glu10;Pra13;Asp28]GpTx-1(1-34) | 2197 |
| DCLGI[Nle]RKCEPD[Pra]DKCCRPNLVCSRLHDWCKYVF-{Amide} | [Ile5;Nle6;Glu10;Pra13;Leu26;Asp28]GpTx-1(1-34) | 2198 |
| DCLGGFRKCDPD[Pra]DKCCRPNLVCSRLHDWCKYVF-{Amide} | [Gly5;Phe6;Asp10,28;Pra13;Leu26]GpTx-1(1-34) | 2199 |
| DCLGAFRKCDPD[Pra]DKCCRPNLVCSRLHDWCKYVF-{Amide} | [Ala5;Phe6;Asp10,28;Pra13;Leu26]GpTx-1(1-34) | 2200 |
| DCLG[2-Abu]FRKCDPD[Pra]DKCCRPNLVCSRLHDWCKYVF-{Amide} | [2-Abu5;Phe6;Asp10,28;Pra13;Leu26]GpTx-1(1-34) | 2201 |
| DCLG[Nva]FRKCDPD[Pra]DKCCRPNLVCSRLHDWCKYVF-{Amide} | [Nva5;Phe6;Asp10,28;Pra13;Leu26]GpTx-1(1-34) | 2202 |
| DCLG[Nle]FRKCDPD[Pra]DKCCRPNLVCSRLHDWCKYVF-{Amide} | [Nle5;Phe6;Asp10,28;Pra13;Leu26]GpTx-1(1-34) | 2203 |
| DCLGVFRKCDPD[Pra]DKCCRPNLVCSRLHDWCKYVF-{Amide} | [Val5;Phe6;Asp10,28;Pra13;Leu26]GpTx-1(1-34) | 2204 |
| DCLGLFRKCDPD[Pra]DKCCRPNLVCSRLHDWCKYVF-{Amide} | [Leu5,26;Phe6;Asp10,28;Pra13]GpTx-1(1-34) | 2205 |
| DCLGIFRKCDPD[Pra]DKCCRPNLVCSRLHDWCKYVF-{Amide} | [Ile5;Phe6;Asp10,28;Pra13;Leu26]GpTx-1(1-34) | 2206 |
| DCLGGLRKCDPD[Pra]DKCCRPNLVCSRLHDWCKYVF-{Amide} | [Gly5;Leu6,26;Asp10,28;Pra13]GpTx-1(1-34) | 2207 |
| DCLGALRKCDPD[Pra]DKCCRPNLVCSRLHDWCKYVF-{Amide} | [Ala5;Leu6,26;Asp10,28;Pra13]GpTx-1(1-34) | 2208 |
| DCLG[2-Abu]LRKCDPD[Pra]DKCCRPNLVCSRLHDWCKYVF-{Amide} | [2-Abu5;Leu6,26;Asp10,28;Pra13]GpTx-1(1-34) | 2209 |
| DCLG[Nva]LRKCDPD[Pra]DKCCRPNLVCSRLHDWCKYVF-{Amide} | [Nva5;Leu6,26;Asp10,28;Pra13]GpTx-1(1-34) | 2210 |
| DCLG[Nle]LRKCDPD[Pra]DKCCRPNLVCSRLHDWCKYVF-{Amide} | [Nle5;Leu6,26;Asp10,28;Pra13]GpTx-1(1-34) | 2211 |
| DCLGVLRKCDPD[Pra]DKCCRPNLVCSRLHDWCKYVF-{Amide} | [Val5;Leu6,26;Asp10,28;Pra13]GpTx-1(1-34) | 2212 |
| DCLGLLRKCDPD[Pra]DKCCRPNLVCSRLHDWCKYVF-{Amide} | [Leu5,6,26;Asp10,28;Pra13]GpTx-1(1-34) | 2213 |
| DCLGILRKCDPD[Pra]DKCCRPNLVCSRLHDWCKYVF-{Amide} | [Ile5;Leu6,26;Asp10,28;Pra13]GpTx-1(1-34) | 2214 |
| DCLGG[Nle]RKCDPD[Pra]DKCCRPNLVCSRLHDWCKYVF-{Amide} | [Gly5;Nle6;Asp10,28;Pra13;Leu26]GpTx-1(1-34) | 2215 |
| DCLGA[Nle]RKCDPD[Pra]DKCCRPNLVCSRLHDWCKYVF-{Amide} | [Ala5;Nle6;Asp10,28;Pra13;Leu26]GpTx-1(1-34) | 2216 |
| DCLG[2-Abu][Nle]RKCDPD[Pra]DKCCRPNLVCSRLHDWCKYVF-{Amide} | [2-Abu5;Nle6;Asp10,28;Pra13;Leu26]GpTx-1(1-34) | 2217 |
| DCLG[Nva][Nle]RKCDPD[Pra]DKCCRPNLVCSRLHDWCKYVF-{Amide} | [Nva5;Nle6;Asp10,28;Pra13;Leu26]GpTx-1(1-34) | 2218 |
| DCLG[Nle][Nle]RKCDPD[Pra]DKCCRPNLVCSRLHDWCKYVF-{Amide} | [Nle5,6;Asp10,28;Pra13;Leu26]GpTx-1(1-34) | 2219 |
| DCLGV[Nle]RKCDPD[Pra]DKCCRPNLVCSRLHDWCKYVF-{Amide} | [Val5;Nle6;Asp10,28;Pra13;Leu26]GpTx-1(1-34) | 2220 |
| DCLGL[Nle]RKCDPD[Pra]DKCCRPNLVCSRLHDWCKYVF-{Amide} | [Leu5,26;Nle6;Asp10,28;Pra13]GpTx-1(1-34) | 2221 |
| DCLGI[Nle]RKCDPD[Pra]DKCCRPNLVCSRLHDWCKYVF-{Amide} | [Ile5;Nle6;Asp10,28;Pra13;Leu26]GpTx-1(1-34) | 2222 |
| DCLGFMRKCIPD[2-Abu]DKCCRPNLVCSRTHQWCKYVF-{Amide} | [2-Abu13;Gln28]GpTx-1(1-34) | 2223 |
| DCLGFMRKCIPD[Pra]DKCCRPNLVCSRTHQWCKYVF-{Amide} | [Pra13;Gln28]GpTx-1(1-34) | 2224 |
| DCLGFMRKCIPD[2-Abu]DKCCRPNLVCSRLHQWCKYVF-{Amide} | [2-Abu13;Leu26;Gln28]GpTx-1(1-34) | 2225 |
| DCLGFMRKCIPD[Pra]DKCCRPNLVCSRLHQWCKYVF-{Amide} | [Pra13;Leu26;Gln28]GpTx-1(1-34) | 2226 |
| DCLGFMRKCIED[2-Abu]DKCCRPNLVCSRTHQWCKYVF-{Amide} | [Glu11;2-Abu13;Gln28]GpTx-1(1-34) | 2227 |
| DCLGFMRKCEPD[2-Abu]DKCCRPNLVCSRTHQWCKYVF-{Amide} | [Glu10;2-Abu13;Gln28]GpTx-1(1-34) | 2228 |
| DCLGFMRKCDPD[2-Abu]DKCCRPNLVCSRTHQWCKYVF-{Amide} | [Asp10;2-Abu13;Gln28]GpTx-1(1-34) | 2229 |
| DCLGFFRKCIPD[2-Abu]DKCCRPNLVCSRTHQWCKYVF-{Amide} | [Phe6;2-Abu13;Gln28]GpTx-1(1-34) | 2230 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFLRKCIPD[2-Abu]DKCCRPNLVCSRTHQWCKYVF-{Amide} | [Leu6;2-Abu13;Gln28]GpTx-1(1-34) | 2231 |
| DCLGF[Nle]RKCIPD[2-Abu]DKCCRPNLVCSRTHQWCKYVF-{Amide} | [Nle6;2-Abu13;Gln28]GpTx-1(1-34) | 2232 |
| DCLGGMRKCIPD[2-Abu]DKCCRPNLVCSRTHQWCKYVF-{Amide} | [Gly5;2-Abu13;Gln28]GpTx-1(1-34) | 2233 |
| DCLGAMRKCIPD[2-Abu]DKCCRPNLVCSRTHQWCKYVF-{Amide} | [Ala5;2-Abu13;Gln28]GpTx-1(1-34) | 2234 |
| DCLG[2-Abu]MRKCIPD[2-Abu]DKCCRPNLVCSRTHQWCKYVF-{Amide} | [2-Abu5,13;Gln28]GpTx-1(1-34) | 2235 |
| DCLG[Nva]MRKCIPD[2-Abu]DKCCRPNLVCSRTHQWCKYVF-{Amide} | [Nva5;2-Abu13;Gln28]GpTx-1(1-34) | 2236 |
| DCLG[Nle]MRKCIPD[2-Abu]DKCCRPNLVCSRTHQWCKYVF-{Amide} | [Nle5;2-Abu13;Gln28]GpTx-1(1-34) | 2237 |
| DCLGVMRKCIPD[2-Abu]DKCCRPNLVCSRTHQWCKYVF-{Amide} | [Val5;2-Abu13;Gln28]GpTx-1(1-34) | 2238 |
| DCLGLMRKCIPD[2-Abu]DKCCRPNLVCSRTHQWCKYVF-{Amide} | [Leu5;2-Abu13;Gln28]GpTx-1(1-34) | 2239 |
| DCLGIMRKCIPD[2-Abu]DKCCRPNLVCSRTHQWCKYVF-{Amide} | [Ile5;2-Abu13;Gln28]GpTx-1(1-34) | 2240 |
| DCLGFMRKCIED[Pra]DKCCRPNLVCSRTHQWCKYVF-{Amide} | [Glu11;Pra13;Gln28]GpTx-1(1-34) | 2241 |
| DCLGFMRKCEPD[Pra]DKCCRPNLVCSRTHQWCKYVF-{Amide} | [Glu10;Pra13;Gln28]GpTx-1(1-34) | 2242 |
| DCLGFMRKCDPD[Pra]DKCCRPNLVCSRTHQWCKYVF-{Amide} | [Asp10;Pra13;Gln28]GpTx-1(1-34) | 2243 |
| DCLGFFRKCIPD[Pra]DKCCRPNLVCSRTHQWCKYVF-{Amide} | [Phe6;Pra13;Gln28]GpTx-1(1-34) | 2244 |
| DCLGFLRKCIPD[Pra]DKCCRPNLVCSRTHQWCKYVF-{Amide} | [Leu6;Pra13;Gln28]GpTx-1(1-34) | 2245 |
| DCLGF[Nle]RKCIPD[Pra]DKCCRPNLVCSRTHQWCKYVF-{Amide} | [Nle6;Pra13;Gln28]GpTx-1(1-34) | 2246 |
| DCLGGMRKCIPD[Pra]DKCCRPNLVCSRTHQWCKYVF-{Amide} | [Gly5;Pra13;Gln28]GpTx-1(1-34) | 2247 |
| DCLGAMRKCIPD[Pra]DKCCRPNLVCSRTHQWCKYVF-{Amide} | [Ala5;Pra13;Gln28]GpTx-1(1-34) | 2248 |
| DCLG[2-Abu]MRKCIPD[Pra]DKCCRPNLVCSRTHQWCKYVF-{Amide} | [2-Abu5;Pra13;Gln28]GpTx-1(1-34) | 2249 |
| DCLG[Nva]MRKCIPD[Pra]DKCCRPNLVCSRTHQWCKYVF-{Amide} | [Nva5;Pra13;Gln28]GpTx-1(1-34) | 2250 |
| DCLG[Nle]MRKCIPD[Pra]DKCCRPNLVCSRTHQWCKYVF-{Amide} | [Nle5;Pra13;Gln28]GpTx-1(1-34) | 2251 |
| DCLGVMRKCIPD[Pra]DKCCRPNLVCSRTHQWCKYVF-{Amide} | [Val5;Pra13;Gln28]GpTx-1(1-34) | 2252 |
| DCLGLMRKCIPD[Pra]DKCCRPNLVCSRTHQWCKYVF-{Amide} | [Leu5;Pra13;Gln28]GpTx-1(1-34) | 2253 |
| DCLGIMRKCIPD[Pra]DKCCRPNLVCSRTHQWCKYVF-{Amide} | [Ile5;Pra13;Gln28]GpTx-1(1-34) | 2254 |
| DCLGFMRKCIED[2-Abu]DKCCRPNLVCSRLHQWCKYVF-{Amide} | [Glu11;2-Abu13;Leu26;Gln28]GpTx-1(1-34) | 2255 |
| DCLGFMRKCEPD[2-Abu]DKCCRPNLVCSRLHQWCKYVF-{Amide} | [Glu10;2-Abu13;Leu26;Gln28]GpTx-1(1-34) | 2256 |
| DCLGFMRKCDPD[2-Abu]DKCCRPNLVCSRLHQWCKYVF-{Amide} | [Asp10;2-Abu13;Leu26;Gln28]GpTx-1(1-34) | 2257 |
| DCLGFFRKCIPD[2-Abu]DKCCRPNLVCSRLHQWCKYVF-{Amide} | [Phe6;2-Abu13;Leu26;Gln28]GpTx-1(1-34) | 2258 |
| DCLGFLRKCIPD[2-Abu]DKCCRPNLVCSRLHQWCKYVF-{Amide} | [Leu6,26;2-Abu13;Gln28]GpTx-1(1-34) | 2259 |
| DCLGF[Nle]RKCIPD[2-Abu]DKCCRPNLVCSRLHQWCKYVF-{Amide} | [Nle6;2-Abu13;Leu26;Gln28]GpTx-1(1-34) | 2260 |
| DCLGGMRKCIPD[2-Abu]DKCCRPNLVCSRLHQWCKYVF-{Amide} | [Gly5;2-Abu13;Leu26;Gln28]GpTx-1(1-34) | 2261 |
| DCLGAMRKCIPD[2-Abu]DKCCRPNLVCSRLHQWCKYVF-{Amide} | [Ala5;2-Abu13;Leu26;Gln28]GpTx-1(1-34) | 2262 |
| DCLG[2-Abu]MRKCIPD[2-Abu]DKCCRPNLVCSRLHQWCKYVF-{Amide} | [2-Abu5,13;Leu26;Gln28]GpTx-1(1-34) | 2263 |
| DCLG[Nva]MRKCIPD[2-Abu]DKCCRPNLVCSRLHQWCKYVF-{Amide} | [Nva5;2-Abu13;Leu26;Gln28]GpTx-1(1-34) | 2264 |
| DCLG[Nle]MRKCIPD[2-Abu]DKCCRPNLVCSRLHQWCKYVF-{Amide} | [Nle5;2-Abu13;Leu26;Gln28]GpTx-1(1-34) | 2265 |
| DCLGVMRKCIPD[2-Abu]DKCCRPNLVCSRLHQWCKYVF-{Amide} | [Val5;2-Abu13;Leu26;Gln28]GpTx-1(1-34) | 2266 |
| DCLGLMRKCIPD[2-Abu]DKCCRPNLVCSRLHQWCKYVF-{Amide} | [Leu5,26;2-Abu13;Gln28]GpTx-1(1-34) | 2267 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGIMRKCIPD[2-Abu]DKCCRPNLVCSRLHQWCKYVF-{Amide} | [Ile5;2-Abu13;Leu26;Gln28]GpTx-1(1-34) | 2268 |
| DCLGFMRKCIED[Pra]DKCCRPNLVCSRLHQWCKYVF-{Amide} | [Glu11;Pra13;Leu26;Gln28]GpTx-1(1-34) | 2269 |
| DCLGFMRKCEPD[Pra]DKCCRPNLVCSRLHQWCKYVF-{Amide} | [Glu10;Pra13;Leu26;Gln28]GpTx-1(1-34) | 2270 |
| DCLGFMRKCDPD[Pra]DKCCRPNLVCSRLHQWCKYVF-{Amide} | [Asp10;Pra13;Leu26;Gln28]GpTx-1(1-34) | 2271 |
| DCLGFFRKCIPD[Pra]DKCCRPNLVCSRLHQWCKYVF-{Amide} | [Phe6;Pra13;Leu26;Gln28]GpTx-1(1-34) | 2272 |
| DCLGFLRKCIPD[Pra]DKCCRPNLVCSRLHQWCKYVF-{Amide} | [Leu6,26;Pra13;Gln28]GpTx-1(1-34) | 2273 |
| DCLGF[Nle]RKCIPD[Pra]DKCCRPNLVCSRLHQWCKYVF-{Amide} | [Nle6;Pra13;Leu26;Gln28]GpTx-1(1-34) | 2274 |
| DCLGGMRKCIPD[Pra]DKCCRPNLVCSRLHQWCKYVF-{Amide} | [Gly5;Pra13;Leu26;Gln28]GpTx-1(1-34) | 2275 |
| DCLGAMRKCIPD[Pra]DKCCRPNLVCSRLHQWCKYVF-{Amide} | [Ala5;Pra13;Leu26;Gln28]GpTx-1(1-34) | 2276 |
| DCLG[2-Abu]MRKCIPD[Pra]DKCCRPNLVCSRLHQWCKYVF-{Amide} | [2-Abu5;Pra13;Leu26;Gln28]GpTx-1(1-34) | 2277 |
| DCLG[Nva]MRKCIPD[Pra]DKCCRPNLVCSRLHQWCKYVF-{Amide} | [Nva5;Pra13;Leu26;Gln28]GpTx-1(1-34) | 2278 |
| DCLG[Nle]MRKCIPD[Pra]DKCCRPNLVCSRLHQWCKYVF-{Amide} | [Nle5;Pra13;Leu26;Gln28]GpTx-1(1-34) | 2279 |
| DCLGVMRKCIPD[Pra]DKCCRPNLVCSRLHQWCKYVF-{Amide} | [Val5;Pra13;Leu26;Gln28]GpTx-1(1-34) | 2280 |
| DCLGLMRKCIPD[Pra]DKCCRPNLVCSRLHQWCKYVF-{Amide} | [Leu5,26;Pra13;Gln28]GpTx-1(1-34) | 2281 |
| DCLGIMRKCIPD[Pra]DKCCRPNLVCSRLHQWCKYVF-{Amide} | [Ile5;Pra13;Leu26;Gln28]GpTx-1(1-34) | 2282 |
| DCLGFFRKCIED[2-Abu]DKCCRPNLVCSRTHQWCKYVF-{Amide} | [Phe6;Glu11;2-Abu13;Gln28]GpTx-1(1-34) | 2283 |
| DCLGFLRKCIED[2-Abu]DKCCRPNLVCSRTHQWCKYVF-{Amide} | [Leu6;Glu11;2-Abu13;Gln28]GpTx-1(1-34) | 2284 |
| DCLGF[Nle]RKCIED[2-Abu]DKCCRPNLVCSRTHQWCKYVF-{Amide} | [Nle6;Glu11;2-Abu13;Gln28]GpTx-1(1-34) | 2285 |
| DCLGGMRKCIED[2-Abu]DKCCRPNLVCSRTHQWCKYVF-{Amide} | [Gly5;Glu11;2-Abu13;Gln28]GpTx-1(1-34) | 2286 |
| DCLGAMRKCIED[2-Abu]DKCCRPNLVCSRTHQWCKYVF-{Amide} | [Ala5;Glu11;2-Abu13;Gln28]GpTx-1(1-34) | 2287 |
| DCLG[2-Abu]MRKCIED[2-Abu]DKCCRPNLVCSRTHQWCKYVF-{Amide} | [2-Abu5,13;Glu11;Gln28]GpTx-1(1-34) | 2288 |
| DCLG[Nva]MRKCIED[2-Abu]DKCCRPNLVCSRTHQWCKYVF-{Amide} | [Nva5;Glu11;2-Abu13;Gln28]GpTx-1(1-34) | 2289 |
| DCLG[Nle]MRKCIED[2-Abu]DKCCRPNLVCSRTHQWCKYVF-{Amide} | [Nle5;Glu11;2-Abu13;Gln28]GpTx-1(1-34) | 2290 |
| DCLGVMRKCIED[2-Abu]DKCCRPNLVCSRTHQWCKYVF-{Amide} | [Val5;Glu11;2-Abu13;Gln28]GpTx-1(1-34) | 2291 |
| DCLGLMRKCIED[2-Abu]DKCCRPNLVCSRTHQWCKYVF-{Amide} | [Leu5;Glu11;2-Abu13;Gln28]GpTx-1(1-34) | 2292 |
| DCLGIMRKCIED[2-Abu]DKCCRPNLVCSRTHQWCKYVF-{Amide} | [Ile5;Glu11;2-Abu13;Gln28]GpTx-1(1-34) | 2293 |
| DCLGFFRKCEPD[2-Abu]DKCCRPNLVCSRTHQWCKYVF-{Amide} | [Phe6;Glu10;2-Abu13;Gln28]GpTx-1(1-34) | 2294 |
| DCLGFLRKCEPD[2-Abu]DKCCRPNLVCSRTHQWCKYVF-{Amide} | [Leu6;Glu10;2-Abu13;Gln28]GpTx-1(1-34) | 2295 |
| DCLGF[Nle]RKCEPD[2-Abu]DKCCRPNLVCSRTHQWCKYVF-{Amide} | [Nle6;Glu10;2-Abu13;Gln28]GpTx-1(1-34) | 2296 |
| DCLGGMRKCEPD[2-Abu]DKCCRPNLVCSRTHQWCKYVF-{Amide} | [Gly5;Glu10;2-Abu13;Gln28]GpTx-1(1-34) | 2297 |
| DCLGAMRKCEPD[2-Abu]DKCCRPNLVCSRTHQWCKYVF-{Amide} | [Ala5;Glu10;2-Abu13;Gln28]GpTx-1(1-34) | 2298 |
| DCLG[2-Abu]MRKCEPD[2-Abu]DKCCRPNLVCSRTHQWCKYVF-{Amide} | [2-Abu5,13;Glu10;Gln28]GpTx-1(1-34) | 2299 |
| DCLG[Nva]MRKCEPD[2-Abu]DKCCRPNLVCSRTHQWCKYVF-{Amide} | [Nva5;Glu10;2-Abu13;Gln28]GpTx-1(1-34) | 2300 |
| DCLG[Nle]MRKCEPD[2-Abu]DKCCRPNLVCSRTHQWCKYVF-{Amide} | [Nle5;Glu10;2-Abu13;Gln28]GpTx-1(1-34) | 2301 |
| DCLGVMRKCEPD[2-Abu]DKCCRPNLVCSRTHQWCKYVF-{Amide} | [Val5;Glu10;2-Abu13;Gln28]GpTx-1(1-34) | 2302 |
| DCLGLMRKCEPD[2-Abu]DKCCRPNLVCSRTHQWCKYVF-{Amide} | [Leu5;Glu10;2-Abu13;Gln28]GpTx-1(1-34) | 2303 |
| DCLGIMRKCEPD[2-Abu]DKCCRPNLVCSRTHQWCKYVF-{Amide} | [Ile5;Glu10;2-Abu13;Gln28]GpTx-1(1-34) | 2304 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFFRKCDPD[2-Abu]DKCCRPNLVCSRTHQWCKYVF-{Amide} | [Phe6;Asp10;2-Abu13;Gln28]GpTx-1(1-34) | 2305 |
| DCLGFLRKCDPD[2-Abu]DKCCRPNLVCSRTHQWCKYVF-{Amide} | [Leu6;Asp10;2-Abu13;Gln28]GpTx-1(1-34) | 2306 |
| DCLGF[Nle]RKCDPD[2-Abu]DKCCRPNLVCSRTHQWCKYVF-{Amide} | [Nle6;Asp10;2-Abu13;Gln28]GpTx-1(1-34) | 2307 |
| DCLGGMRKCDPD[2-Abu]DKCCRPNLVCSRTHQWCKYVF-{Amide} | [Gly5;Asp10;2-Abu13;Gln28]GpTx-1(1-34) | 2308 |
| DCLGAMRKCDPD[2-Abu]DKCCRPNLVCSRTHQWCKYVF-{Amide} | [Ala5;Asp10;2-Abu13;Gln28]GpTx-1(1-34) | 2309 |
| DCLG[2-Abu]MRKCDPD[2-Abu]DKCCRPNLVCSRTHQWCKYVF-{Amide} | [2-Abu5,13;Asp10;Gln28]GpTx-1(1-34) | 2310 |
| DCLG[Nva]MRKCDPD[2-Abu]DKCCRPNLVCSRTHQWCKYVF-{Amide} | [Nva5;Asp10;2-Abu13;Gln28]GpTx-1(1-34) | 2311 |
| DCLG[Nle]MRKCDPD[2-Abu]DKCCRPNLVCSRTHQWCKYVF-{Amide} | [Nle5;Asp10;2-Abu13;Gln28]GpTx-1(1-34) | 2312 |
| DCLGVMRKCDPD[2-Abu]DKCCRPNLVCSRTHQWCKYVF-{Amide} | [Val5;Asp10;2-Abu13;Gln28]GpTx-1(1-34) | 2313 |
| DCLGLMRKCDPD[2-Abu]DKCCRPNLVCSRTHQWCKYVF-{Amide} | [Leu5;Asp10;2-Abu13;Gln28]GpTx-1(1-34) | 2314 |
| DCLGIMRKCDPD[2-Abu]DKCCRPNLVCSRTHQWCKYVF-{Amide} | [Ile5;Asp10;2-Abu13;Gln28]GpTx-1(1-34) | 2315 |
| DCLGGFRKCIPD[2-Abu]DKCCRPNLVCSRTHQWCKYVF-{Amide} | [Gly5;Phe6;2-Abu13;Gln28]GpTx-1(1-34) | 2316 |
| DCLGAFRKCIPD[2-Abu]DKCCRPNLVCSRTHQWCKYVF-{Amide} | [Ala5;Phe6;2-Abu13;Gln28]GpTx-1(1-34) | 2317 |
| DCLG[2-Abu]FRKCIPD[2-Abu]DKCCRPNLVCSRTHQWCKYVF-{Amide} | [2-Abu5,13;Phe6;Gln28]GpTx-1(1-34) | 2318 |
| DCLG[Nva]FRKCIPD[2-Abu]DKCCRPNLVCSRTHQWCKYVF-{Amide} | [Nva5;Phe6;2-Abu13;Gln28]GpTx-1(1-34) | 2319 |
| DCLG[Nle]FRKCIPD[2-Abu]DKCCRPNLVCSRTHQWCKYVF-{Amide} | [Nle5;Phe6;2-Abu13;Gln28]GpTx-1(1-34) | 2320 |
| DCLGVFRKCIPD[2-Abu]DKCCRPNLVCSRTHQWCKYVF-{Amide} | [Val5;Phe6;2-Abu13;Gln28]GpTx-1(1-34) | 2321 |
| DCLGLFRKCIPD[2-Abu]DKCCRPNLVCSRTHQWCKYVF-{Amide} | [Leu5;Phe6;2-Abu13;Gln28]GpTx-1(1-34) | 2322 |
| DCLGIFRKCIPD[2-Abu]DKCCRPNLVCSRTHQWCKYVF-{Amide} | [Ile5;Phe6;2-Abu13;Gln28]GpTx-1(1-34) | 2323 |
| DCLGGLRKCIPD[2-Abu]DKCCRPNLVCSRTHQWCKYVF-{Amide} | [Gly5;Leu6;2-Abu13;Gln28]GpTx-1(1-34) | 2324 |
| DCLGALRKCIPD[2-Abu]DKCCRPNLVCSRTHQWCKYVF-{Amide} | [Ala5;Leu6;2-Abu13;Gln28]GpTx-1(1-34) | 2325 |
| DCLG[2-Abu]LRKCIPD[2-Abu]DKCCRPNLVCSRTHQWCKYVF-{Amide} | [2-Abu5,13;Leu6;Gln28]GpTx-1(1-34) | 2326 |
| DCLG[Nva]LRKCIPD[2-Abu]DKCCRPNLVCSRTHQWCKYVF-{Amide} | [Nva5;Leu6;2-Abu13;Gln28]GpTx-1(1-34) | 2327 |
| DCLG[Nle]LRKCIPD[2-Abu]DKCCRPNLVCSRTHQWCKYVF-{Amide} | [Nle5;Leu6;2-Abu13;Gln28]GpTx-1(1-34) | 2328 |
| DCLGVLRKCIPD[2-Abu]DKCCRPNLVCSRTHQWCKYVF-{Amide} | [Val5;Leu6;2-Abu13;Gln28]GpTx-1(1-34) | 2329 |
| DCLGLLRKCIPD[2-Abu]DKCCRPNLVCSRTHQWCKYVF-{Amide} | [Leu5,6;2-Abu13;Gln28]GpTx-1(1-34) | 2330 |
| DCLGILRKCIPD[2-Abu]DKCCRPNLVCSRTHQWCKYVF-{Amide} | [Ile5;Leu6;2-Abu13;Gln28]GpTx-1(1-34) | 2331 |
| DCLGG[Nle]RKCIPD[2-Abu]DKCCRPNLVCSRTHQWCKYVF-{Amide} | [Gly5;Nle6;2-Abu13;Gln28]GpTx-1(1-34) | 2332 |
| DCLGA[Nle]RKCIPD[2-Abu]DKCCRPNLVCSRTHQWCKYVF-{Amide} | [Ala5;Nle6;2-Abu13;Gln28]GpTx-1(1-34) | 2333 |
| DCLG[2-Abu][Nle]RKCIPD[2-Abu]DKCCRPNLVCSRTHQWCKYVF-{Amide} | [2-Abu5,13;Nle6;Gln28]GpTx-1(1-34) | 2334 |
| DCLG[Nva][Nle]RKCIPD[2-Abu]DKCCRPNLVCSRTHQWCKYVF-{Amide} | [Nva5;Nle6;2-Abu13;Gln28]GpTx-1(1-34) | 2335 |
| DCLG[Nle][Nle]RKCIPD[2-Abu]DKCCRPNLVCSRTHQWCKYVF-{Amide} | [Nle5,6;2-Abu13;Gln28]GpTx-1(1-34) | 2336 |
| DCLGV[Nle]RKCIPD[2-Abu]DKCCRPNLVCSRTHQWCKYVF-{Amide} | [Val5;Nle6;2-Abu13;Gln28]GpTx-1(1-34) | 2337 |
| DCLGL[Nle]RKCIPD[2-Abu]DKCCRPNLVCSRTHQWCKYVF-{Amide} | [Leu5;Nle6;2-Abu13;Gln28]GpTx-1(1-34) | 2338 |
| DCLGI[Nle]RKCIPD[2-Abu]DKCCRPNLVCSRTHQWCKYVF-{Amide} | [Ile5;Nle6;2-Abu13;Gln28]GpTx-1(1-34) | 2339 |
| DCLGFFRKCIED[Pra]DKCCRPNLVCSRTHQWCKYVF-{Amide} | [Phe6;Glu11;Pra13;Gln28]GpTx-1(1-34) | 2340 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGFLRKCIED[Pra]DKCCRPNLVCSRTHQWCKYVF-{Amide} | [Leu6;Glu11;Pra13;Gln28]GpTx-1(1-34) | 2341 |
| DCLGF[Nle]RKCIED[Pra]DKCCRPNLVCSRTHQWCKYVF-{Amide} | [Nle6;Glu11;Pra13;Gln28]GpTx-1(1-34) | 2342 |
| DCLGGMRKCIED[Pra]DKCCRPNLVCSRTHQWCKYVF-{Amide} | [Gly5;Glu11;Pra13;Gln28]GpTx-1(1-34) | 2343 |
| DCLGAMRKCIED[Pra]DKCCRPNLVCSRTHQWCKYVF-{Amide} | [Ala5;Glu11;Pra13;Gln28]GpTx-1(1-34) | 2344 |
| DCLG[2-Abu]MRKCIED[Pra]DKCCRPNLVCSRTHQWCKYVF-{Amide} | [2-Abu5;Glu11;Pra13;Gln28]GpTx-1(1-34) | 2345 |
| DCLG[Nva]MRKCIED[Pra]DKCCRPNLVCSRTHQWCKYVF-{Amide} | [Nva5;Glu11;Pra13;Gln28]GpTx-1(1-34) | 2346 |
| DCLG[Nle]MRKCIED[Pra]DKCCRPNLVCSRTHQWCKYVF-{Amide} | [Nle5;Glu11;Pra13;Gln28]GpTx-1(1-34) | 2347 |
| DCLGVMRKCIED[Pra]DKCCRPNLVCSRTHQWCKYVF-{Amide} | [Val5;Glu11;Pra13;Gln28]GpTx-1(1-34) | 2348 |
| DCLGLMRKCIED[Pra]DKCCRPNLVCSRTHQWCKYVF-{Amide} | [Leu5;Glu11;Pra13;Gln28]GpTx-1(1-34) | 2349 |
| DCLGIMRKCIED[Pra]DKCCRPNLVCSRTHQWCKYVF-{Amide} | [Ile5;Glu11;Pra13;Gln28]GpTx-1(1-34) | 2350 |
| DCLGFFRKCEPD[Pra]DKCCRPNLVCSRTHQWCKYVF-{Amide} | [Phe6;Glu10;Pra13;Gln28]GpTx-1(1-34) | 2351 |
| DCLGFLRKCEPD[Pra]DKCCRPNLVCSRTHQWCKYVF-{Amide} | [Leu6;Glu10;Pra13;Gln28]GpTx-1(1-34) | 2352 |
| DCLGF[Nle]RKCEPD[Pra]DKCCRPNLVCSRTHQWCKYVF-{Amide} | [Nle6;Glu10;Pra13;Gln28]GpTx-1(1-34) | 2353 |
| DCLGGMRKCEPD[Pra]DKCCRPNLVCSRTHQWCKYVF-{Amide} | [Gly5;Glu10;Pra13;Gln28]GpTx-1(1-34) | 2354 |
| DCLGAMRKCEPD[Pra]DKCCRPNLVCSRTHQWCKYVF-{Amide} | [Ala5;Glu10;Pra13;Gln28]GpTx-1(1-34) | 2355 |
| DCLG[2-Abu]MRKCEPD[Pra]DKCCRPNLVCSRTHQWCKYVF-{Amide} | [2-Abu5;Glu10;Pra13;Gln28]GpTx-1(1-34) | 2356 |
| DCLG[Nva]MRKCEPD[Pra]DKCCRPNLVCSRTHQWCKYVF-{Amide} | [Nva5;Glu10;Pra13;Gln28]GpTx-1(1-34) | 2357 |
| DCLG[Nle]MRKCEPD[Pra]DKCCRPNLVCSRTHQWCKYVF-{Amide} | [Nle5;Glu10;Pra13;Gln28]GpTx-1(1-34) | 2358 |
| DCLGVMRKCEPD[Pra]DKCCRPNLVCSRTHQWCKYVF-{Amide} | [Val5;Glu10;Pra13;Gln28]GpTx-1(1-34) | 2359 |
| DCLGLMRKCEPD[Pra]DKCCRPNLVCSRTHQWCKYVF-{Amide} | [Leu5;Glu10;Pra13;Gln28]GpTx-1(1-34) | 2360 |
| DCLGIMRKCEPD[Pra]DKCCRPNLVCSRTHQWCKYVF-{Amide} | [Ile5;Glu10;Pra13;Gln28]GpTx-1(1-34) | 2361 |
| DCLGFFRKCDPD[Pra]DKCCRPNLVCSRTHQWCKYVF-{Amide} | [Phe6;Asp10;Pra13;Gln28]GpTx-1(1-34) | 2362 |
| DCLGFLRKCDPD[Pra]DKCCRPNLVCSRTHQWCKYVF-{Amide} | [Leu6;Asp10;Pra13;Gln28]GpTx-1(1-34) | 2363 |
| DCLGF[Nle]RKCDPD[Pra]DKCCRPNLVCSRTHQWCKYVF-{Amide} | [Nle6;Asp10;Pra13;Gln28]GpTx-1(1-34) | 2364 |
| DCLGGMRKCDPD[Pra]DKCCRPNLVCSRTHQWCKYVF-{Amide} | [Gly5;Asp10;Pra13;Gln28]GpTx-1(1-34) | 2365 |
| DCLGAMRKCDPD[Pra]DKCCRPNLVCSRTHQWCKYVF-{Amide} | [Ala5;Asp10;Pra13;Gln28]GpTx-1(1-34) | 2366 |
| DCLG[2-Abu]MRKCDPD[Pra]DKCCRPNLVCSRTHQWCKYVF-{Amide} | [2-Abu5;Asp10;Pra13;Gln28]GpTx-1(1-34) | 2367 |
| DCLG[Nva]MRKCDPD[Pra]DKCCRPNLVCSRTHQWCKYVF-{Amide} | [Nva5;Asp10;Pra13;Gln28]GpTx-1(1-34) | 2368 |
| DCLG[Nle]MRKCDPD[Pra]DKCCRPNLVCSRTHQWCKYVF-{Amide} | [Nle5;Asp10;Pra13;Gln28]GpTx-1(1-34) | 2369 |
| DCLGVMRKCDPD[Pra]DKCCRPNLVCSRTHQWCKYVF-{Amide} | [Val5;Asp10;Pra13;Gln28]GpTx-1(1-34) | 2370 |
| DCLGLMRKCDPD[Pra]DKCCRPNLVCSRTHQWCKYVF-{Amide} | [Leu5;Asp10;Pra13;Gln28]GpTx-1(1-34) | 2371 |
| DCLGIMRKCDPD[Pra]DKCCRPNLVCSRTHQWCKYVF-{Amide} | [Ile5;Asp10;Pra13;Gln28]GpTx-1(1-34) | 2372 |
| DCLGGFRKCIPD[Pra]DKCCRPNLVCSRTHQWCKYVF-{Amide} | [Gly5;Phe6;Pra13;Gln28]GpTx-1(1-34) | 2373 |
| DCLGAFRKCIPD[Pra]DKCCRPNLVCSRTHQWCKYVF-{Amide} | [Ala5;Phe6;Pra13;Gln28]GpTx-1(1-34) | 2374 |
| DCLG[2-Abu]FRKCIPD[Pra]DKCCRPNLVCSRTHQWCKYVF-{Amide} | [2-Abu5;Phe6;Pra13;Gln28]GpTx-1(1-34) | 2375 |
| DCLG[Nva]FRKCIPD[Pra]DKCCRPNLVCSRTHQWCKYVF-{Amide} | [Nva5;Phe6;Pra13;Gln28]GpTx-1(1-34) | 2376 |
| DCLG[Nle]FRKCIPD[Pra]DKCCRPNLVCSRTHQWCKYVF-{Amide} | [Nle5;Phe6;Pra13;Gln28]GpTx-1(1-34) | 2377 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGVFRKCIPD[Pra]DKCCRPNLVCSRTHQWCKYVF-{Amide} | [Val5;Phe6;Pra13;Gln28]GpTx-1(1-34) | 2378 |
| DCLGLFRKCIPD[Pra]DKCCRPNLVCSRTHQWCKYVF-{Amide} | [Leu5;Phe6;Pra13;Gln28]GpTx-1(1-34) | 2379 |
| DCLGIFRKCIPD[Pra]DKCCRPNLVCSRTHQWCKYVF-{Amide} | [Ile5;Phe6;Pra13;Gln28]GpTx-1(1-34) | 2380 |
| DCLGGLRKCIPD[Pra]DKCCRPNLVCSRTHQWCKYVF-{Amide} | [Gly5;Leu6;Pra13;Gln28]GpTx-1(1-34) | 2381 |
| DCLGALRKCIPD[Pra]DKCCRPNLVCSRTHQWCKYVF-{Amide} | [Ala5;Leu6;Pra13;Gln28]GpTx-1(1-34) | 2382 |
| DCLG[2-Abu]LRKCIPD[Pra]DKCCRPNLVCSRTHQWCKYVF-{Amide} | [2-Abu5;Leu6;Pra13;Gln28]GpTx-1(1-34) | 2383 |
| DCLG[Nva]LRKCIPD[Pra]DKCCRPNLVCSRTHQWCKYVF-{Amide} | [Nva5;Leu6;Pra13;Gln28]GpTx-1(1-34) | 2384 |
| DCLG[Nle]LRKCIPD[Pra]DKCCRPNLVCSRTHQWCKYVF-{Amide} | [Nle5;Leu6;Pra13;Gln28]GpTx-1(1-34) | 2385 |
| DCLGVLRKCIPD[Pra]DKCCRPNLVCSRTHQWCKYVF-{Amide} | [Val5;Leu6;Pra13;Gln28]GpTx-1(1-34) | 2386 |
| DCLGLLRKCIPD[Pra]DKCCRPNLVCSRTHQWCKYVF-{Amide} | [Leu5,6;Pra13;Gln28]GpTx-1(1-34) | 2387 |
| DCLGILRKCIPD[Pra]DKCCRPNLVCSRTHQWCKYVF-{Amide} | [Ile5;Leu6;Pra13;Gln28]GpTx-1(1-34) | 2388 |
| DCLGG[Nle]RKCIPD[Pra]DKCCRPNLVCSRTHQWCKYVF-{Amide} | [Gly5;Nle6;Pra13;Gln28]GpTx-1(1-34) | 2389 |
| DCLGA[Nle]RKCIPD[Pra]DKCCRPNLVCSRTHQWCKYVF-{Amide} | [Ala5;Nle6;Pra13;Gln28]GpTx-1(1-34) | 2390 |
| DCLG[2-Abu][Nle]RKCIPD[Pra]DKCCRPNLVCSRTHQWCKYVF-{Amide} | [2-Abu5;Nle6;Pra13;Gln28]GpTx-1(1-34) | 2391 |
| DCLG[Nva][Nle]RKCIPD[Pra]DKCCRPNLVCSRTHQWCKYVF-{Amide} | [Nva5;Nle6;Pra13;Gln28]GpTx-1(1-34) | 2392 |
| DCLG[Nle][Nle]RKCIPD[Pra]DKCCRPNLVCSRTHQWCKYVF-{Amide} | [Nle5,6;Pra13;Gln28]GpTx-1(1-34) | 2393 |
| DCLGV[Nle]RKCIPD[Pra]DKCCRPNLVCSRTHQWCKYVF-{Amide} | [Val5;Nle6;Pra13;Gln28]GpTx-1(1-34) | 2394 |
| DCLGL[Nle]RKCIPD[Pra]DKCCRPNLVCSRTHQWCKYVF-{Amide} | [Leu5;Nle6;Pra13;Gln28]GpTx-1(1-34) | 2395 |
| DCLGI[Nle]RKCIPD[Pra]DKCCRPNLVCSRTHQWCKYVF-{Amide} | [Ile5;Nle6;Pra13;Gln28]GpTx-1(1-34) | 2396 |
| DCLGFFRKCIED[2-Abu]DKCCRPNLVCSRLHQWCKYVF-{Amide} | [Phe6;Glu11;2-Abu13;Leu26;Gln28]GpTx-1(1-34) | 2397 |
| DCLGFLRKCIED[2-Abu]DKCCRPNLVCSRLHQWCKYVF-{Amide} | [Leu6,26;Glu11;2-Abu13;Gln28]GpTx-1(1-34) | 2398 |
| DCLGF[Nle]RKCIED[2-Abu]DKCCRPNLVCSRLHQWCKYVF-{Amide} | [Nle6;Glu11;2-Abu13;Leu26;Gln28]GpTx-1(1-34) | 2399 |
| DCLGGMRKCIED[2-Abu]DKCCRPNLVCSRLHQWCKYVF-{Amide} | [Gly5;Glu11;2-Abu13;Leu26;Gln28]GpTx-1(1-34) | 2400 |
| DCLGAMRKCIED[2-Abu]DKCCRPNLVCSRLHQWCKYVF-{Amide} | [Ala5;Glu11;2-Abu13;Leu26;Gln28]GpTx-1(1-34) | 2401 |
| DCLG[2-Abu]MRKCIED[2-Abu]DKCCRPNLVCSRLHQWCKYVF-{Amide} | [2-Abu5,13;Glu11;Leu26;Gln28]GpTx-1(1-34) | 2402 |
| DCLG[Nva]MRKCIED[2-Abu]DKCCRPNLVCSRLHQWCKYVF-{Amide} | [Nva5;Glu11;2-Abu13;Leu26;Gln28]GpTx-1(1-34) | 2403 |
| DCLG[Nle]MRKCIED[2-Abu]DKCCRPNLVCSRLHQWCKYVF-{Amide} | [Nle5;Glu11;2-Abu13;Leu26;Gln28]GpTx-1(1-34) | 2404 |
| DCLGVMRKCIED[2-Abu]DKCCRPNLVCSRLHQWCKYVF-{Amide} | [Val5;Glu11;2-Abu13;Leu26;Gln28]GpTx-1(1-34) | 2405 |
| DCLGLMRKCIED[2-Abu]DKCCRPNLVCSRLHQWCKYVF-{Amide} | [Leu5,26;Glu11;2-Abu13;Gln28]GpTx-1(1-34) | 2406 |
| DCLGIMRKCIED[2-Abu]DKCCRPNLVCSRLHQWCKYVF-{Amide} | [Ile5;Glu11;2-Abu13;Leu26;Gln28]GpTx-1(1-34) | 2407 |
| DCLGFFRKCEPD[2-Abu]DKCCRPNLVCSRLHQWCKYVF-{Amide} | [Phe6;Glu10;2-Abu13;Leu26;Gln28]GpTx-1(1-34) | 2408 |
| DCLGFLRKCEPD[2-Abu]DKCCRPNLVCSRLHQWCKYVF-{Amide} | [Leu6,26;Glu10;2-Abu13;Gln28]GpTx-1(1-34) | 2409 |
| DCLGF[Nle]RKCEPD[2-Abu]DKCCRPNLVCSRLHQWCKYVF-{Amide} | [Nle6;Glu10;2-Abu13;Leu26;Gln28]GpTx-1(1-34) | 2410 |
| DCLGGMRKCEPD[2-Abu]DKCCRPNLVCSRLHQWCKYVF-{Amide} | [Gly5;Glu10;2-Abu13;Leu26;Gln28]GpTx-1(1-34) | 2411 |
| DCLGAMRKCEPD[2-Abu]DKCCRPNLVCSRLHQWCKYVF-{Amide} | [Ala5;Glu10;2-Abu13;Leu26;Gln28]GpTx-1(1-34) | 2412 |
| DCLG[2-Abu]MRKCEPD[2-Abu]DKCCRPNLVCSRLHQWCKYVF-{Amide} | [2-Abu5,13;Glu10;Leu26;Gln28]GpTx-1(1-34) | 2413 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva]MRKCEPD[2-Abu]DKCCRPNLVCSRLHQWCKYVF-{Amide} | [Nva5;Glu10;2-Abu13;Leu26;Gln28]GpTx-1(1-34) | 2414 |
| DCLG[Nle]MRKCEPD[2-Abu]DKCCRPNLVCSRLHQWCKYVF-{Amide} | [Nle5;Glu10;2-Abu13;Leu26;Gln28]GpTx-1(1-34) | 2415 |
| DCLGVMRKCEPD[2-Abu]DKCCRPNLVCSRLHQWCKYVF-{Amide} | [Val5;Glu10;2-Abu13;Leu26;Gln28]GpTx-1(1-34) | 2416 |
| DCLGLMRKCEPD[2-Abu]DKCCRPNLVCSRLHQWCKYVF-{Amide} | [Leu5,26;Glu10;2-Abu13;Gln28]GpTx-1(1-34) | 2417 |
| DCLGIMRKCEPD[2-Abu]DKCCRPNLVCSRLHQWCKYVF-{Amide} | [Ile5;Glu10;2-Abu13;Leu26;Gln28]GpTx-1(1-34) | 2418 |
| DCLGFFRKCDPD[2-Abu]DKCCRPNLVCSRLHQWCKYVF-{Amide} | [Phe6;Asp10;2-Abu13;Leu26;Gln28]GpTx-1(1-34) | 2419 |
| DCLGFLRKCDPD[2-Abu]DKCCRPNLVCSRLHQWCKYVF-{Amide} | [Leu6,26;Asp10;2-Abu13;Gln28]GpTx-1(1-34) | 2420 |
| DCLGF[Nle]RKCDPD[2-Abu]DKCCRPNLVCSRLHQWCKYVF-{Amide} | [Nle6;Asp10;2-Abu13;Leu26;Gln28]GpTx-1(1-34) | 2421 |
| DCLGGMRKCDPD[2-Abu]DKCCRPNLVCSRLHQWCKYVF-{Amide} | [Gly5;Asp10;2-Abu13;Leu26;Gln28]GpTx-1(1-34) | 2422 |
| DCLGAMRKCDPD[2-Abu]DKCCRPNLVCSRLHQWCKYVF-{Amide} | [Ala5;Asp10;2-Abu13;Leu26;Gln28]GpTx-1(1-34) | 2423 |
| DCLG[2-Abu]MRKCDPD[2-Abu]DKCCRPNLVCSRLHQWCKYVF-{Amide} | [2-Abu5,13;Asp10;Leu26;Gln28]GpTx-1(1-34) | 2424 |
| DCLG[Nva]MRKCDPD[2-Abu]DKCCRPNLVCSRLHQWCKYVF-{Amide} | [Nva5;Asp10;2-Abu13;Leu26;Gln28]GpTx-1(1-34) | 2425 |
| DCLG[Nle]MRKCDPD[2-Abu]DKCCRPNLVCSRLHQWCKYVF-{Amide} | [Nle5;Asp10;2-Abu13;Leu26;Gln28]GpTx-1(1-34) | 2426 |
| DCLGVMRKCDPD[2-Abu]DKCCRPNLVCSRLHQWCKYVF-{Amide} | [Val5;Asp10;2-Abu13;Leu26;Gln28]GpTx-1(1-34) | 2427 |
| DCLGLMRKCDPD[2-Abu]DKCCRPNLVCSRLHQWCKYVF-{Amide} | [Leu5,26;Asp10;2-Abu13;Gln28]GpTx-1(1-34) | 2428 |
| DCLGIMRKCDPD[2-Abu]DKCCRPNLVCSRLHQWCKYVF-{Amide} | [Ile5;Asp10;2-Abu13;Leu26;Gln28]GpTx-1(1-34) | 2429 |
| DCLGGFRKCIPD[2-Abu]DKCCRPNLVCSRLHQWCKYVF-{Amide} | [Gly5;Phe6;2-Abu13;Leu26;Gln28]GpTx-1(1-34) | 2430 |
| DCLGAFRKCIPD[2-Abu]DKCCRPNLVCSRLHQWCKYVF-{Amide} | [Ala5;Phe6;2-Abu13;Leu26;Gln28]GpTx-1(1-34) | 2431 |
| DCLG[2-Abu]FRKCIPD[2-Abu]DKCCRPNLVCSRLHQWCKYVF-{Amide} | [2-Abu5,13;Phe6;Leu26;Gln28]GpTx-1(1-34) | 2432 |
| DCLG[Nva]FRKCIPD[2-Abu]DKCCRPNLVCSRLHQWCKYVF-{Amide} | [Nva5;Phe6;2-Abu13;Leu26;Gln28]GpTx-1(1-34) | 2433 |
| DCLG[Nle]FRKCIPD[2-Abu]DKCCRPNLVCSRLHQWCKYVF-{Amide} | [Nle5;Phe6;2-Abu13;Leu26;Gln28]GpTx-1(1-34) | 2434 |
| DCLGVFRKCIPD[2-Abu]DKCCRPNLVCSRLHQWCKYVF-{Amide} | [Val5;Phe6;2-Abu13;Leu26;Gln28]GpTx-1(1-34) | 2435 |
| DCLGLFRKCIPD[2-Abu]DKCCRPNLVCSRLHQWCKYVF-{Amide} | [Leu5,26;Phe6;2-Abu13;Gln28]GpTx-1(1-34) | 2436 |
| DCLGIFRKCIPD[2-Abu]DKCCRPNLVCSRLHQWCKYVF-{Amide} | [Ile5;Phe6;2-Abu13;Leu26;Gln28]GpTx-1(1-34) | 2437 |
| DCLGGLRKCIPD[2-Abu]DKCCRPNLVCSRLHQWCKYVF-{Amide} | [Gly5;Leu6,26;2-Abu13;Gln28]GpTx-1(1-34) | 2438 |
| DCLGALRKCIPD[2-Abu]DKCCRPNLVCSRLHQWCKYVF-{Amide} | [Ala5;Leu6,26;2-Abu13;Gln28]GpTx-1(1-34) | 2439 |
| DCLG[2-Abu]LRKCIPD[2-Abu]DKCCRPNLVCSRLHQWCKYVF-{Amide} | [2-Abu5,13;Leu6,26;Gln28]GpTx-1(1-34) | 2440 |
| DCLG[Nva]LRKCIPD[2-Abu]DKCCRPNLVCSRLHQWCKYVF-{Amide} | [Nva5;Leu6,26;2-Abu13;Gln28]GpTx-1(1-34) | 2441 |
| DCLG[Nle]LRKCIPD[2-Abu]DKCCRPNLVCSRLHQWCKYVF-{Amide} | [Nle5;Leu6,26;2-Abu13;Gln28]GpTx-1(1-34) | 2442 |
| DCLGVLRKCIPD[2-Abu]DKCCRPNLVCSRLHQWCKYVF-{Amide} | [Val5;Leu6,26;2-Abu13;Gln28]GpTx-1(1-34) | 2443 |
| DCLGLLRKCIPD[2-Abu]DKCCRPNLVCSRLHQWCKYVF-{Amide} | [Leu5,6,26;2-Abu13;Gln28]GpTx-1(1-34) | 2444 |
| DCLGILRKCIPD[2-Abu]DKCCRPNLVCSRLHQWCKYVF-{Amide} | [Ile5;Leu6,26;2-Abu13;Gln28]GpTx-1(1-34) | 2445 |
| DCLGG[Nle]RKCIPD[2-Abu]DKCCRPNLVCSRLHQWCKYVF-{Amide} | [Gly5;Nle6;2-Abu13;Leu26;Gln28]GpTx-1(1-34) | 2446 |
| DCLGA[Nle]RKCIPD[2-Abu]DKCCRPNLVCSRLHQWCKYVF-{Amide} | [Ala5;Nle6;2-Abu13;Leu26;Gln28]GpTx-1(1-34) | 2447 |
| DCLG[2-Abu][Nle]RKCIPD[2-Abu]DKCCRPNLVCSRLHQWCKYVF-{Amide} | [2-Abu5,13;Nle6;Leu26;Gln28]GpTx-1(1-34) | 2448 |
| DCLG[Nva][Nle]RKCIPD[2-Abu]DKCCRPNLVCSRLHQWCKYVF-{Amide} | [Nva5;Nle6;2-Abu13;Leu26;Gln28]GpTx-1(1-34) | 2449 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nle][Nle]RKCIPD[2-Abu]DKCCRPNLVCSRLHQWCKYVF-{Amide} | [Nle5,6;2-Abu13;Leu26;Gln28]GpTx-1(1-34) | 2450 |
| DCLGV[Nle]RKCIPD[2-Abu]DKCCRPNLVCSRLHQWCKYVF-{Amide} | [Val5;Nle6;2-Abu13;Leu26;Gln28]GpTx-1(1-34) | 2451 |
| DCLGL[Nle]RKCIPD[2-Abu]DKCCRPNLVCSRLHQWCKYVF-{Amide} | [Leu5,26;Nle6;2-Abu13;Gln28]GpTx-1(1-34) | 2452 |
| DCLGI[Nle]RKCIPD[2-Abu]DKCCRPNLVCSRLHQWCKYVF-{Amide} | [Ile5;Nle6;2-Abu13;Leu26;Gln28]GpTx-1(1-34) | 2453 |
| DCLGFFRKCIED[Pra]DKCCRPNLVCSRLHQWCKYVF-{Amide} | [Phe6;Glu11;Pra13;Leu26;Gln28]GpTx-1(1-34) | 2454 |
| DCLGFLRKCIED[Pra]DKCCRPNLVCSRLHQWCKYVF-{Amide} | [Leu6,26;Glu11;Pra13;Gln28]GpTx-1(1-34) | 2455 |
| DCLGF[Nle]RKCIED[Pra]DKCCRPNLVCSRLHQWCKYVF-{Amide} | [Nle6;Glu11;Pra13;Leu26;Gln28]GpTx-1(1-34) | 2456 |
| DCLGGMRKCIED[Pra]DKCCRPNLVCSRLHQWCKYVF-{Amide} | [Gly5;Glu11;Pra13;Leu26;Gln28]GpTx-1(1-34) | 2457 |
| DCLGAMRKCIED[Pra]DKCCRPNLVCSRLHQWCKYVF-{Amide} | [Ala5;Glu11;Pra13;Leu26;Gln28]GpTx-1(1-34) | 2458 |
| DCLG[2-Abu]MRKCIED[Pra]DKCCRPNLVCSRLHQWCKYVF-{Amide} | [2-Abu5;Glu11;Pra13;Leu26;Gln28]GpTx-1(1-34) | 2459 |
| DCLG[Nva]MRKCIED[Pra]DKCCRPNLVCSRLHQWCKYVF-{Amide} | [Nva5;Glu11;Pra13;Leu26;Gln28]GpTx-1(1-34) | 2460 |
| DCLG[Nle]MRKCIED[Pra]DKCCRPNLVCSRLHQWCKYVF-{Amide} | [Nle5;Glu11;Pra13;Leu26;Gln28]GpTx-1(1-34) | 2461 |
| DCLGVMRKCIED[Pra]DKCCRPNLVCSRLHQWCKYVF-{Amide} | [Val5;Glu11;Pra13;Leu26;Gln28]GpTx-1(1-34) | 2462 |
| DCLGLMRKCIED[Pra]DKCCRPNLVCSRLHQWCKYVF-{Amide} | [Leu5,26;Glu11;Pra13;Gln28]GpTx-1(1-34) | 2463 |
| DCLGIMRKCIED[Pra]DKCCRPNLVCSRLHQWCKYVF-{Amide} | [Ile5;Glu11;Pra13;Leu26;Gln28]GpTx-1(1-34) | 2464 |
| DCLGFFRKCEPD[Pra]DKCCRPNLVCSRLHQWCKYVF-{Amide} | [Phe6;Glu10;Pra13;Leu26;Gln28]GpTx-1(1-34) | 2465 |
| DCLGFLRKCEPD[Pra]DKCCRPNLVCSRLHQWCKYVF-{Amide} | [Leu6,26;Glu10;Pra13;Gln28]GpTx-1(1-34) | 2466 |
| DCLGF[Nle]RKCEPD[Pra]DKCCRPNLVCSRLHQWCKYVF-{Amide} | [Nle6;Glu10;Pra13;Leu26;Gln28]GpTx-1(1-34) | 2467 |
| DCLGGMRKCEPD[Pra]DKCCRPNLVCSRLHQWCKYVF-{Amide} | [Gly5;Glu10;Pra13;Leu26;Gln28]GpTx-1(1-34) | 2468 |
| DCLGAMRKCEPD[Pra]DKCCRPNLVCSRLHQWCKYVF-{Amide} | [Ala5;Glu10;Pra13;Leu26;Gln28]GpTx-1(1-34) | 2469 |
| DCLG[2-Abu]MRKCEPD[Pra]DKCCRPNLVCSRLHQWCKYVF-{Amide} | [2-Abu5;Glu10;Pra13;Leu26;Gln28]GpTx-1(1-34) | 2470 |
| DCLG[Nva]MRKCEPD[Pra]DKCCRPNLVCSRLHQWCKYVF-{Amide} | [Nva5;Glu10;Pra13;Leu26;Gln28]GpTx-1(1-34) | 2471 |
| DCLG[Nle]MRKCEPD[Pra]DKCCRPNLVCSRLHQWCKYVF-{Amide} | [Nle5;Glu10;Pra13;Leu26;Gln28]GpTx-1(1-34) | 2472 |
| DCLGVMRKCEPD[Pra]DKCCRPNLVCSRLHQWCKYVF-{Amide} | [Val5;Glu10;Pra13;Leu26;Gln28]GpTx-1(1-34) | 2473 |
| DCLGLMRKCEPD[Pra]DKCCRPNLVCSRLHQWCKYVF-{Amide} | [Leu5,26;Glu10;Pra13;Gln28]GpTx-1(1-34) | 2474 |
| DCLGIMRKCEPD[Pra]DKCCRPNLVCSRLHQWCKYVF-{Amide} | [Ile5;Glu10;Pra13;Leu26;Gln28]GpTx-1(1-34) | 2475 |
| DCLGFFRKCDPD[Pra]DKCCRPNLVCSRLHQWCKYVF-{Amide} | [Phe6;Asp10;Pra13;Leu26;Gln28]GpTx-1(1-34) | 2476 |
| DCLGFLRKCDPD[Pra]DKCCRPNLVCSRLHQWCKYVF-{Amide} | [Leu6,26;Asp10;Pra13;Gln28]GpTx-1(1-34) | 2477 |
| DCLGF[Nle]RKCDPD[Pra]DKCCRPNLVCSRLHQWCKYVF-{Amide} | [Nle6;Asp10;Pra13;Leu26;Gln28]GpTx-1(1-34) | 2478 |
| DCLGGMRKCDPD[Pra]DKCCRPNLVCSRLHQWCKYVF-{Amide} | [Gly5;Asp10;Pra13;Leu26;Gln28]GpTx-1(1-34) | 2479 |
| DCLGAMRKCDPD[Pra]DKCCRPNLVCSRLHQWCKYVF-{Amide} | [Ala5;Asp10;Pra13;Leu26;Gln28]GpTx-1(1-34) | 2480 |
| DCLG[2-Abu]MRKCDPD[Pra]DKCCRPNLVCSRLHQWCKYVF-{Amide} | [2-Abu5;Asp10;Pra13;Leu26;Gln28]GpTx-1(1-34) | 2481 |
| DCLG[Nva]MRKCDPD[Pra]DKCCRPNLVCSRLHQWCKYVF-{Amide} | [Nva5;Asp10;Pra13;Leu26;Gln28]GpTx-1(1-34) | 2482 |
| DCLG[Nle]MRKCDPD[Pra]DKCCRPNLVCSRLHQWCKYVF-{Amide} | [Nle5;Asp10;Pra13;Leu26;Gln28]GpTx-1(1-34) | 2483 |
| DCLGVMRKCDPD[Pra]DKCCRPNLVCSRLHQWCKYVF-{Amide} | [Val5;Asp10;Pra13;Leu26;Gln28]GpTx-1(1-34) | 2484 |
| DCLGLMRKCDPD[Pra]DKCCRPNLVCSRLHQWCKYVF-{Amide} | [Leu5,26;Asp10;Pra13;Gln28]GpTx-1(1-34) | 2485 |
| DCLGIMRKCDPD[Pra]DKCCRPNLVCSRLHQWCKYVF-{Amide} | [Ile5;Asp10;Pra13;Leu26;Gln28]GpTx-1(1-34) | 2486 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGFRKCIPD[Pra]DKCCRPNLVCSRLHQWCKYVF-{Amide} | [Gly5;Phe6;Pra13;Leu26;Gln28]GpTx-1(1-34) | 2487 |
| DCLGAFRKCIPD[Pra]DKCCRPNLVCSRLHQWCKYVF-{Amide} | [Ala5;Phe6;Pra13;Leu26;Gln28]GpTx-1(1-34) | 2488 |
| DCLG[2-Abu]FRKCIPD[Pra]DKCCRPNLVCSRLHQWCKYVF-{Amide} | [2-Abu5;Phe6;Pra13;Leu26;Gln28]GpTx-1(1-34) | 2489 |
| DCLG[Nva]FRKCIPD[Pra]DKCCRPNLVCSRLHQWCKYVF-{Amide} | [Nva5;Phe6;Pra13;Leu26;Gln28]GpTx-1(1-34) | 2490 |
| DCLG[Nle]FRKCIPD[Pra]DKCCRPNLVCSRLHQWCKYVF-{Amide} | [Nle5;Phe6;Pra13;Leu26;Gln28]GpTx-1(1-34) | 2491 |
| DCLGVFRKCIPD[Pra]DKCCRPNLVCSRLHQWCKYVF-{Amide} | [Val5;Phe6;Pra13;Leu26;Gln28]GpTx-1(1-34) | 2492 |
| DCLGLFRKCIPD[Pra]DKCCRPNLVCSRLHQWCKYVF-{Amide} | [Leu5,26;Phe6;Pra13;Gln28]GpTx-1(1-34) | 2493 |
| DCLGIFRKCIPD[Pra]DKCCRPNLVCSRLHQWCKYVF-{Amide} | [Ile5;Phe6;Pra13;Leu26;Gln28]GpTx-1(1-34) | 2494 |
| DCLGGLRKCIPD[Pra]DKCCRPNLVCSRLHQWCKYVF-{Amide} | [Gly5;Leu6,26;Pra13;Gln28]GpTx-1(1-34) | 2495 |
| DCLGALRKCIPD[Pra]DKCCRPNLVCSRLHQWCKYVF-{Amide} | [Ala5;Leu6,26;Pra13;Gln28]GpTx-1(1-34) | 2496 |
| DCLG[2-Abu]LRKCIPD[Pra]DKCCRPNLVCSRLHQWCKYVF-{Amide} | [2-Abu5;Leu6,26;Pra13;Gln28]GpTx-1(1-34) | 2497 |
| DCLG[Nva]LRKCIPD[Pra]DKCCRPNLVCSRLHQWCKYVF-{Amide} | [Nva5;Leu6,26;Pra13;Gln28]GpTx-1(1-34) | 2498 |
| DCLG[Nle]LRKCIPD[Pra]DKCCRPNLVCSRLHQWCKYVF-{Amide} | [Nle5;Leu6,26;Pra13;Gln28]GpTx-1(1-34) | 2499 |
| DCLGVLRKCIPD[Pra]DKCCRPNLVCSRLHQWCKYVF-{Amide} | [Val5;Leu6,26;Pra13;Gln28]GpTx-1(1-34) | 2500 |
| DCLGLLRKCIPD[Pra]DKCCRPNLVCSRLHQWCKYVF-{Amide} | [Leu5,6,26;Pra13;Gln28]GpTx-1(1-34) | 2501 |
| DCLGILRKCIPD[Pra]DKCCRPNLVCSRLHQWCKYVF-{Amide} | [Ile5;Leu6,26;Pra13;Gln28]GpTx-1(1-34) | 2502 |
| DCLGG[Nle]RKCIPD[Pra]DKCCRPNLVCSRLHQWCKYVF-{Amide} | [Gly5;Nle6;Pra13;Leu26;Gln28]GpTx-1(1-34) | 2503 |
| DCLGA[Nle]RKCIPD[Pra]DKCCRPNLVCSRLHQWCKYVF-{Amide} | [Ala5;Nle6;Pra13;Leu26;Gln28]GpTx-1(1-34) | 2504 |
| DCLG[2-Abu][Nle]RKCIPD[Pra]DKCCRPNLVCSRLHQWCKYVF-{Amide} | [2-Abu5;Nle6;Pra13;Leu26;Gln28]GpTx-1(1-34) | 2505 |
| DCLG[Nva][Nle]RKCIPD[Pra]DKCCRPNLVCSRLHQWCKYVF-{Amide} | [Nva5;Nle6;Pra13;Leu26;Gln28]GpTx-1(1-34) | 2506 |
| DCLG[Nle][Nle]RKCIPD[Pra]DKCCRPNLVCSRLHQWCKYVF-{Amide} | [Nle5,6;Pra13;Leu26;Gln28]GpTx-1(1-34) | 2507 |
| DCLGV[Nle]RKCIPD[Pra]DKCCRPNLVCSRLHQWCKYVF-{Amide} | [Val5;Nle6;Pra13;Leu26;Gln28]GpTx-1(1-34) | 2508 |
| DCLGL[Nle]RKCIPD[Pra]DKCCRPNLVCSRLHQWCKYVF-{Amide} | [Leu5,26;Nle6;Pra13;Gln28]GpTx-1(1-34) | 2509 |
| DCLGI[Nle]RKCIPD[Pra]DKCCRPNLVCSRLHQWCKYVF-{Amide} | [Ile5;Nle6;Pra13;Leu26;Gln28]GpTx-1(1-34) | 2510 |
| DCLGGFRKCIED[2-Abu]DKCCRPNLVCSRTHQWCKYVF-{Amide} | [Gly5;Phe6;Glu11;2-Abu13;Gln28]GpTx-1(1-34) | 2511 |
| DCLGAFRKCIED[2-Abu]DKCCRPNLVCSRTHQWCKYVF-{Amide} | [Ala5;Phe6;Glu11;2-Abu13;Gln28]GpTx-1(1-34) | 2512 |
| DCLG[2-Abu]FRKCIED[2-Abu]DKCCRPNLVCSRTHQWCKYVF-{Amide} | [2-Abu5,13;Phe6;Glu11;Gln28]GpTx-1(1-34) | 2513 |
| DCLG[Nva]FRKCIED[2-Abu]DKCCRPNLVCSRTHQWCKYVF-{Amide} | [Nva5;Phe6;Glu11;2-Abu13;Gln28]GpTx-1(1-34) | 2514 |
| DCLG[Nle]FRKCIED[2-Abu]DKCCRPNLVCSRTHQWCKYVF-{Amide} | [Nle5;Phe6;Glu11;2-Abu13;Gln28]GpTx-1(1-34) | 2515 |
| DCLGVFRKCIED[2-Abu]DKCCRPNLVCSRTHQWCKYVF-{Amide} | [Val5;Phe6;Glu11;2-Abu13;Gln28]GpTx-1(1-34) | 2516 |
| DCLGLFRKCIED[2-Abu]DKCCRPNLVCSRTHQWCKYVF-{Amide} | [Leu5;Phe6;Glu11;2-Abu13;Gln28]GpTx-1(1-34) | 2517 |
| DCLGIFRKCIED[2-Abu]DKCCRPNLVCSRTHQWCKYVF-{Amide} | [Ile5;Phe6;Glu11;2-Abu13;Gln28]GpTx-1(1-34) | 2518 |
| DCLGGLRKCIED[2-Abu]DKCCRPNLVCSRTHQWCKYVF-{Amide} | [Gly5;Leu6;Glu11;2-Abu13;Gln28]GpTx-1(1-34) | 2519 |
| DCLGALRKCIED[2-Abu]DKCCRPNLVCSRTHQWCKYVF-{Amide} | [Ala5;Leu6;Glu11;2-Abu13;Gln28]GpTx-1(1-34) | 2520 |
| DCLG[2-Abu]LRKCIED[2-Abu]DKCCRPNLVCSRTHQWCKYVF-{Amide} | [2-Abu5,13;Leu6;Glu11;Gln28]GpTx-1(1-34) | 2521 |
| DCLG[Nva]LRKCIED[2-Abu]DKCCRPNLVCSRTHQWCKYVF-{Amide} | [Nva5;Leu6;Glu11;2-Abu13;Gln28]GpTx-1(1-34) | 2522 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nle]LRKCIED[2-Abu]DKCCRPNLVCSRTHQWCKYVF-{Amide} | [Nle5;Leu6;Glu11;2-Abu13;Gln28]GpTx-1(1-34) | 2523 |
| DCLGVLRKCIED[2-Abu]DKCCRPNLVCSRTHQWCKYVF-{Amide} | [Val5;Leu6;Glu11;2-Abu13;Gln28]GpTx-1(1-34) | 2524 |
| DCLGLLRKCIED[2-Abu]DKCCRPNLVCSRTHQWCKYVF-{Amide} | [Leu5,6;Glu11;2-Abu13;Gln28]GpTx-1(1-34) | 2525 |
| DCLGILRKCIED[2-Abu]DKCCRPNLVCSRTHQWCKYVF-{Amide} | [Ile5;Leu6;Glu11;2-Abu13;Gln28]GpTx-1(1-34) | 2526 |
| DCLGG[Nle]RKCIED[2-Abu]DKCCRPNLVCSRTHQWCKYVF-{Amide} | [Gly5;Nle6;Glu11;2-Abu13;Gln28]GpTx-1(1-34) | 2527 |
| DCLGA[Nle]RKCIED[2-Abu]DKCCRPNLVCSRTHQWCKYVF-{Amide} | [Ala5;Nle6;Glu11;2-Abu13;Gln28]GpTx-1(1-34) | 2528 |
| DCLG[2-Abu][Nle]RKCIED[2-Abu]DKCCRPNLVCSRTHQWCKYVF-{Amide} | [2-Abu5,13;Nle6;Glu11;Gln28]GpTx-1(1-34) | 2529 |
| DCLG[Nva][Nle]RKCIED[2-Abu]DKCCRPNLVCSRTHQWCKYVF-{Amide} | [Nva5;Nle6;Glu11;2-Abu13;Gln28]GpTx-1(1-34) | 2530 |
| DCLG[Nle][Nle]RKCIED[2-Abu]DKCCRPNLVCSRTHQWCKYVF-{Amide} | [Nle5,6;Glu11;2-Abu13;Gln28]GpTx-1(1-34) | 2531 |
| DCLGV[Nle]RKCIED[2-Abu]DKCCRPNLVCSRTHQWCKYVF-{Amide} | [Val5;Nle6;Glu11;2-Abu13;Gln28]GpTx-1(1-34) | 2532 |
| DCLGL[Nle]RKCIED[2-Abu]DKCCRPNLVCSRTHQWCKYVF-{Amide} | [Leu5;Nle6;Glu11;2-Abu13;Gln28]GpTx-1(1-34) | 2533 |
| DCLGI[Nle]RKCIED[2-Abu]DKCCRPNLVCSRTHQWCKYVF-{Amide} | [Ile5;Nle6;Glu11;2-Abu13;Gln28]GpTx-1(1-34) | 2534 |
| DCLGGFRKCEPD[2-Abu]DKCCRPNLVCSRTHQWCKYVF-{Amide} | [Gly5;Phe6;Glu10;2-Abu13;Gln28]GpTx-1(1-34) | 2535 |
| DCLGAFRKCEPD[2-Abu]DKCCRPNLVCSRTHQWCKYVF-{Amide} | [Ala5;Phe6;Glu10;2-Abu13;Gln28]GpTx-1(1-34) | 2536 |
| DCLG[2-Abu]FRKCEPD[2-Abu]DKCCRPNLVCSRTHQWCKYVF-{Amide} | [2-Abu5,13;Phe6;Glu10;Gln28]GpTx-1(1-34) | 2537 |
| DCLG[Nva]FRKCEPD[2-Abu]DKCCRPNLVCSRTHQWCKYVF-{Amide} | [Nva5;Phe6;Glu10;2-Abu13;Gln28]GpTx-1(1-34) | 2538 |
| DCLG[Nle]FRKCEPD[2-Abu]DKCCRPNLVCSRTHQWCKYVF-{Amide} | [Nle5;Phe6;Glu10;2-Abu13;Gln28]GpTx-1(1-34) | 2539 |
| DCLGVFRKCEPD[2-Abu]DKCCRPNLVCSRTHQWCKYVF-{Amide} | [Val5;Phe6;Glu10;2-Abu13;Gln28]GpTx-1(1-34) | 2540 |
| DCLGLFRKCEPD[2-Abu]DKCCRPNLVCSRTHQWCKYVF-{Amide} | [Leu5;Phe6;Glu10;2-Abu13;Gln28]GpTx-1(1-34) | 2541 |
| DCLGIFRKCEPD[2-Abu]DKCCRPNLVCSRTHQWCKYVF-{Amide} | [Ile5;Phe6;Glu10;2-Abu13;Gln28]GpTx-1(1-34) | 2542 |
| DCLGGLRKCEPD[2-Abu]DKCCRPNLVCSRTHQWCKYVF-{Amide} | [Gly5;Leu6;Glu10;2-Abu13;Gln28]GpTx-1(1-34) | 2543 |
| DCLGALRKCEPD[2-Abu]DKCCRPNLVCSRTHQWCKYVF-{Amide} | [Ala5;Leu6;Glu10;2-Abu13;Gln28]GpTx-1(1-34) | 2544 |
| DCLG[2-Abu]LRKCEPD[2-Abu]DKCCRPNLVCSRTHQWCKYVF-{Amide} | [2-Abu5,13;Leu6;Glu10;Gln28]GpTx-1(1-34) | 2545 |
| DCLG[Nva]LRKCEPD[2-Abu]DKCCRPNLVCSRTHQWCKYVF-{Amide} | [Nva5;Leu6;Glu10;2-Abu13;Gln28]GpTx-1(1-34) | 2546 |
| DCLG[Nle]LRKCEPD[2-Abu]DKCCRPNLVCSRTHQWCKYVF-{Amide} | [Nle5;Leu6;Glu10;2-Abu13;Gln28]GpTx-1(1-34) | 2547 |
| DCLGVLRKCEPD[2-Abu]DKCCRPNLVCSRTHQWCKYVF-{Amide} | [Val5;Leu6;Glu10;2-Abu13;Gln28]GpTx-1(1-34) | 2548 |
| DCLGLLRKCEPD[2-Abu]DKCCRPNLVCSRTHQWCKYVF-{Amide} | [Leu5,6;Glu10;2-Abu13;Gln28]GpTx-1(1-34) | 2549 |
| DCLGILRKCEPD[2-Abu]DKCCRPNLVCSRTHQWCKYVF-{Amide} | [Ile5;Leu6;Glu10;2-Abu13;Gln28]GpTx-1(1-34) | 2550 |
| DCLGG[Nle]RKCEPD[2-Abu]DKCCRPNLVCSRTHQWCKYVF-{Amide} | [Gly5;Nle6;Glu10;2-Abu13;Gln28]GpTx-1(1-34) | 2551 |
| DCLGA[Nle]RKCEPD[2-Abu]DKCCRPNLVCSRTHQWCKYVF-{Amide} | [Ala5;Nle6;Glu10;2-Abu13;Gln28]GpTx-1(1-34) | 2552 |
| DCLG[2-Abu][Nle]RKCEPD[2-Abu]DKCCRPNLVCSRTHQWCKYVF-{Amide} | [2-Abu5,13;Nle6;Glu10;Gln28]GpTx-1(1-34) | 2553 |
| DCLG[Nva][Nle]RKCEPD[2-Abu]DKCCRPNLVCSRTHQWCKYVF-{Amide} | [Nva5;Nle6;Glu10;2-Abu13;Gln28]GpTx-1(1-34) | 2554 |
| DCLG[Nle][Nle]RKCEPD[2-Abu]DKCCRPNLVCSRTHQWCKYVF-{Amide} | [Nle5,6;Glu10;2-Abu13;Gln28]GpTx-1(1-34) | 2555 |
| DCLGV[Nle]RKCEPD[2-Abu]DKCCRPNLVCSRTHQWCKYVF-{Amide} | [Val5;Nle6;Glu10;2-Abu13;Gln28]GpTx-1(1-34) | 2556 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGL[Nle]RKCEPD[2-Abu]DKCCRPNLVCSRTHQWCKYVF-{Amide} | [Leu5;Nle6;Glu10;2-Abu13;Gln28]GpTx-1(1-34) | 2557 |
| DCLGI[Nle]RKCEPD[2-Abu]DKCCRPNLVCSRTHQWCKYVF-{Amide} | [Ile5;Nle6;Glu10;2-Abu13;Gln28]GpTx-1(1-34) | 2558 |
| DCLGGFRKCDPD[2-Abu]DKCCRPNLVCSRTHQWCKYVF-{Amide} | [Gly5;Phe6;Asp10;2-Abu13;Gln28]GpTx-1(1-34) | 2559 |
| DCLGAFRKCDPD[2-Abu]DKCCRPNLVCSRTHQWCKYVF-{Amide} | [Ala5;Phe6;Asp10;2-Abu13;Gln28]GpTx-1(1-34) | 2560 |
| DCLG[2-Abu]FRKCDPD[2-Abu]DKCCRPNLVCSRTHQWCKYVF-{Amide} | [2-Abu5,13;Phe6;Asp10;Gln28]GpTx-1(1-34) | 2561 |
| DCLG[Nva]FRKCDPD[2-Abu]DKCCRPNLVCSRTHQWCKYVF-{Amide} | [Nva5;Phe6;Asp10;2-Abu13;Gln28]GpTx-1(1-34) | 2562 |
| DCLG[Nle]FRKCDPD[2-Abu]DKCCRPNLVCSRTHQWCKYVF-{Amide} | [Nle5;Phe6;Asp10;2-Abu13;Gln28]GpTx-1(1-34) | 2563 |
| DCLGVFRKCDPD[2-Abu]DKCCRPNLVCSRTHQWCKYVF-{Amide} | [Val5;Phe6;Asp10;2-Abu13;Gln28]GpTx-1(1-34) | 2564 |
| DCLGLFRKCDPD[2-Abu]DKCCRPNLVCSRTHQWCKYVF-{Amide} | [Leu5;Phe6;Asp10;2-Abu13;Gln28]GpTx-1(1-34) | 2565 |
| DCLGIFRKCDPD[2-Abu]DKCCRPNLVCSRTHQWCKYVF-{Amide} | [Ile5;Phe6;Asp10;2-Abu13;Gln28]GpTx-1(1-34) | 2566 |
| DCLGGLRKCDPD[2-Abu]DKCCRPNLVCSRTHQWCKYVF-{Amide} | [Gly5;Leu6;Asp10;2-Abu13;Gln28]GpTx-1(1-34) | 2567 |
| DCLGALRKCDPD[2-Abu]DKCCRPNLVCSRTHQWCKYVF-{Amide} | [Ala5;Leu6;Asp10;2-Abu13;Gln28]GpTx-1(1-34) | 2568 |
| DCLG[2-Abu]LRKCDPD[2-Abu]DKCCRPNLVCSRTHQWCKYVF-{Amide} | [2-Abu5,13;Leu6;Asp10;Gln28]GpTx-1(1-34) | 2569 |
| DCLG[Nva]LRKCDPD[2-Abu]DKCCRPNLVCSRTHQWCKYVF-{Amide} | [Nva5;Leu6;Asp10;2-Abu13;Gln28]GpTx-1(1-34) | 2570 |
| DCLG[Nle]LRKCDPD[2-Abu]DKCCRPNLVCSRTHQWCKYVF-{Amide} | [Nle5;Leu6;Asp10;2-Abu13;Gln28]GpTx-1(1-34) | 2571 |
| DCLGVLRKCDPD[2-Abu]DKCCRPNLVCSRTHQWCKYVF-{Amide} | [Val5;Leu6;Asp10;2-Abu13;Gln28]GpTx-1(1-34) | 2572 |
| DCLGLLRKCDPD[2-Abu]DKCCRPNLVCSRTHQWCKYVF-{Amide} | [Leu5,6;Asp10;2-Abu13;Gln28]GpTx-1(1-34) | 2573 |
| DCLGILRKCDPD[2-Abu]DKCCRPNLVCSRTHQWCKYVF-{Amide} | [Ile5;Leu6;Asp10;2-Abu13;Gln28]GpTx-1(1-34) | 2574 |
| DCLGG[Nle]RKCDPD[2-Abu]DKCCRPNLVCSRTHQWCKYVF-{Amide} | [Gly5;Nle6;Asp10;2-Abu13;Gln28]GpTx-1(1-34) | 2575 |
| DCLGA[Nle]RKCDPD[2-Abu]DKCCRPNLVCSRTHQWCKYVF-{Amide} | [Ala5;Nle6;Asp10;2-Abu13;Gln28]GpTx-1(1-34) | 2576 |
| DCLG[2-Abu][Nle]RKCDPD[2-Abu]DKCCRPNLVCSRTHQWCKYVF-{Amide} | [2-Abu5,13;Nle6;Asp10;Gln28]GpTx-1(1-34) | 2577 |
| DCLG[Nva][Nle]RKCDPD[2-Abu]DKCCRPNLVCSRTHQWCKYVF-{Amide} | [Nva5;Nle6;Asp10;2-Abu13;Gln28]GpTx-1(1-34) | 2578 |
| DCLG[Nle][Nle]RKCDPD[2-Abu]DKCCRPNLVCSRTHQWCKYVF-{Amide} | [Nle5,6;Asp10;2-Abu13;Gln28]GpTx-1(1-34) | 2579 |
| DCLGV[Nle]RKCDPD[2-Abu]DKCCRPNLVCSRTHQWCKYVF-{Amide} | [Val5;Nle6;Asp10;2-Abu13;Gln28]GpTx-1(1-34) | 2580 |
| DCLGL[Nle]RKCDPD[2-Abu]DKCCRPNLVCSRTHQWCKYVF-{Amide} | [Leu5;Nle6;Asp10;2-Abu13;Gln28]GpTx-1(1-34) | 2581 |
| DCLGI[Nle]RKCDPD[2-Abu]DKCCRPNLVCSRTHQWCKYVF-{Amide} | [Ile5;Nle6;Asp10;2-Abu13;Gln28]GpTx-1(1-34) | 2582 |
| DCLGGFRKCIED[Pra]DKCCRPNLVCSRTHQWCKYVF-{Amide} | [Gly5;Phe6;Glu11;Pra13;Gln28]GpTx-1(1-34) | 2583 |
| DCLGAFRKCIED[Pra]DKCCRPNLVCSRTHQWCKYVF-{Amide} | [Ala5;Phe6;Glu11;Pra13;Gln28]GpTx-1(1-34) | 2584 |
| DCLG[2-Abu]FRKCIED[Pra]DKCCRPNLVCSRTHQWCKYVF-{Amide} | [2-Abu5;Phe6;Glu11;Pra13;Gln28]GpTx-1(1-34) | 2585 |
| DCLG[Nva]FRKCIED[Pra]DKCCRPNLVCSRTHQWCKYVF-{Amide} | [Nva5;Phe6;Glu11;Pra13;Gln28]GpTx-1(1-34) | 2586 |
| DCLG[Nle]FRKCIED[Pra]DKCCRPNLVCSRTHQWCKYVF-{Amide} | [Nle5;Phe6;Glu11;Pra13;Gln28]GpTx-1(1-34) | 2587 |
| DCLGVFRKCIED[Pra]DKCCRPNLVCSRTHQWCKYVF-{Amide} | [Val5;Phe6;Glu11;Pra13;Gln28]GpTx-1(1-34) | 2588 |
| DCLGLFRKCIED[Pra]DKCCRPNLVCSRTHQWCKYVF-{Amide} | [Leu5;Phe6;Glu11;Pra13;Gln28]GpTx-1(1-34) | 2589 |
| DCLGIFRKCIED[Pra]DKCCRPNLVCSRTHQWCKYVF-{Amide} | [Ile5;Phe6;Glu11;Pra13;Gln28]GpTx-1(1-34) | 2590 |
| DCLGGLRKCIED[Pra]DKCCRPNLVCSRTHQWCKYVF-{Amide} | [Gly5;Leu6;Glu11;Pra13;Gln28]GpTx-1(1-34) | 2591 |
| DCLGALRKCIED[Pra]DKCCRPNLVCSRTHQWCKYVF-{Amide} | [Ala5;Leu6;Glu11;Pra13;Gln28]GpTx-1(1-34) | 2592 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[2-Abu]LRKCIED[Pra]DKCCRPNLVCSRTHQWCKYVF-{Amide} | [2-Abu5;Leu6;Glu11;Pra13;Gln28]GpTx-1(1-34) | 2593 |
| DCLG[Nva]LRKCIED[Pra]DKCCRPNLVCSRTHQWCKYVF-{Amide} | [Nva5;Leu6;Glu11;Pra13;Gln28]GpTx-1(1-34) | 2594 |
| DCLG[Nle]LRKCIED[Pra]DKCCRPNLVCSRTHQWCKYVF-{Amide} | [Nle5;Leu6;Glu11;Pra13;Gln28]GpTx-1(1-34) | 2595 |
| DCLGVLRKCIED[Pra]DKCCRPNLVCSRTHQWCKYVF-{Amide} | [Val5;Leu6;Glu11;Pra13;Gln28]GpTx-1(1-34) | 2596 |
| DCLGLLRKCIED[Pra]DKCCRPNLVCSRTHQWCKYVF-{Amide} | [Leu5,6;Glu11;Pra13;Gln28]GpTx-1(1-34) | 2597 |
| DCLGILRKCIED[Pra]DKCCRPNLVCSRTHQWCKYVF-{Amide} | [Ile5;Leu6;Glu11;Pra13;Gln28]GpTx-1(1-34) | 2598 |
| DCLGG[Nle]RKCIED[Pra]DKCCRPNLVCSRTHQWCKYVF-{Amide} | [Gly5;Nle6;Glu11;Pra13;Gln28]GpTx-1(1-34) | 2599 |
| DCLGA[Nle]RKCIED[Pra]DKCCRPNLVCSRTHQWCKYVF-{Amide} | [Ala5;Nle6;Glu11;Pra13;Gln28]GpTx-1(1-34) | 2600 |
| DCLG[2-Abu][Nle]RKCIED[Pra]DKCCRPNLVCSRTHQWCKYVF-{Amide} | [2-Abu5;Nle6;Glu11;Pra13;Gln28]GpTx-1(1-34) | 2601 |
| DCLG[Nva][Nle]RKCIED[Pra]DKCCRPNLVCSRTHQWCKYVF-{Amide} | [Nva5;Nle6;Glu11;Pra13;Gln28]GpTx-1(1-34) | 2602 |
| DCLG[Nle][Nle]RKCIED[Pra]DKCCRPNLVCSRTHQWCKYVF-{Amide} | [Nle5,6;Glu11;Pra13;Gln28]GpTx-1(1-34) | 2603 |
| DCLGV[Nle]RKCIED[Pra]DKCCRPNLVCSRTHQWCKYVF-{Amide} | [Val5;Nle6;Glu11;Pra13;Gln28]GpTx-1(1-34) | 2604 |
| DCLGL[Nle]RKCIED[Pra]DKCCRPNLVCSRTHQWCKYVF-{Amide} | [Leu5;Nle6;Glu11;Pra13;Gln28]GpTx-1(1-34) | 2605 |
| DCLGI[Nle]RKCIED[Pra]DKCCRPNLVCSRTHQWCKYVF-{Amide} | [Ile5;Nle6;Glu11;Pra13;Gln28]GpTx-1(1-34) | 2606 |
| DCLGGFRKCEPD[Pra]DKCCRPNLVCSRTHQWCKYVF-{Amide} | [Gly5;Phe6;Glu10;Pra13;Gln28]GpTx-1(1-34) | 2607 |
| DCLGAFRKCEPD[Pra]DKCCRPNLVCSRTHQWCKYVF-{Amide} | [Ala5;Phe6;Glu10;Pra13;Gln28]GpTx-1(1-34) | 2608 |
| DCLG[2-Abu]FRKCEPD[Pra]DKCCRPNLVCSRTHQWCKYVF-{Amide} | [2-Abu5;Phe6;Glu10;Pra13;Gln28]GpTx-1(1-34) | 2609 |
| DCLG[Nva]FRKCEPD[Pra]DKCCRPNLVCSRTHQWCKYVF-{Amide} | [Nva5;Phe6;Glu10;Pra13;Gln28]GpTx-1(1-34) | 2610 |
| DCLG[Nle]FRKCEPD[Pra]DKCCRPNLVCSRTHQWCKYVF-{Amide} | [Nle5;Phe6;Glu10;Pra13;Gln28]GpTx-1(1-34) | 2611 |
| DCLGVFRKCEPD[Pra]DKCCRPNLVCSRTHQWCKYVF-{Amide} | [Val5;Phe6;Glu10;Pra13;Gln28]GpTx-1(1-34) | 2612 |
| DCLGLFRKCEPD[Pra]DKCCRPNLVCSRTHQWCKYVF-{Amide} | [Leu5;Phe6;Glu10;Pra13;Gln28]GpTx-1(1-34) | 2613 |
| DCLGIFRKCEPD[Pra]DKCCRPNLVCSRTHQWCKYVF-{Amide} | [Ile5;Phe6;Glu10;Pra13;Gln28]GpTx-1(1-34) | 2614 |
| DCLGGLRKCEPD[Pra]DKCCRPNLVCSRTHQWCKYVF-{Amide} | [Gly5;Leu6;Glu10;Pra13;Gln28]GpTx-1(1-34) | 2615 |
| DCLGALRKCEPD[Pra]DKCCRPNLVCSRTHQWCKYVF-{Amide} | [Ala5;Leu6;Glu10;Pra13;Gln28]GpTx-1(1-34) | 2616 |
| DCLG[2-Abu]LRKCEPD[Pra]DKCCRPNLVCSRTHQWCKYVF-{Amide} | [2-Abu5;Leu6;Glu10;Pra13;Gln28]GpTx-1(1-34) | 2617 |
| DCLG[Nva]LRKCEPD[Pra]DKCCRPNLVCSRTHQWCKYVF-{Amide} | [Nva5;Leu6;Glu10;Pra13;Gln28]GpTx-1(1-34) | 2618 |
| DCLG[Nle]LRKCEPD[Pra]DKCCRPNLVCSRTHQWCKYVF-{Amide} | [Nle5;Leu6;Glu10;Pra13;Gln28]GpTx-1(1-34) | 2619 |
| DCLGVLRKCEPD[Pra]DKCCRPNLVCSRTHQWCKYVF-{Amide} | [Val5;Leu6;Glu10;Pra13;Gln28]GpTx-1(1-34) | 2620 |
| DCLGLLRKCEPD[Pra]DKCCRPNLVCSRTHQWCKYVF-{Amide} | [Leu5,6;Glu10;Pra13;Gln28]GpTx-1(1-34) | 2621 |
| DCLGILRKCEPD[Pra]DKCCRPNLVCSRTHQWCKYVF-{Amide} | [Ile5;Leu6;Glu10;Pra13;Gln28]GpTx-1(1-34) | 2622 |
| DCLGG[Nle]RKCEPD[Pra]DKCCRPNLVCSRTHQWCKYVF-{Amide} | [Gly5;Nle6;Glu10;Pra13;Gln28]GpTx-1(1-34) | 2623 |
| DCLGA[Nle]RKCEPD[Pra]DKCCRPNLVCSRTHQWCKYVF-{Amide} | [Ala5;Nle6;Glu10;Pra13;Gln28]GpTx-1(1-34) | 2624 |
| DCLG[2-Abu][Nle]RKCEPD[Pra]DKCCRPNLVCSRTHQWCKYVF-{Amide} | [2-Abu5;Nle6;Glu10;Pra13;Gln28]GpTx-1(1-34) | 2625 |
| DCLG[Nva][Nle]RKCEPD[Pra]DKCCRPNLVCSRTHQWCKYVF-{Amide} | [Nva5;Nle6;Glu10;Pra13;Gln28]GpTx-1(1-34) | 2626 |
| DCLG[Nle][Nle]RKCEPD[Pra]DKCCRPNLVCSRTHQWCKYVF-{Amide} | [Nle5,6;Glu10;Pra13;Gln28]GpTx-1(1-34) | 2627 |
| DCLGV[Nle]RKCEPD[Pra]DKCCRPNLVCSRTHQWCKYVF-{Amide} | [Val5;Nle6;Glu10;Pra13;Gln28]GpTx-1(1-34) | 2628 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGL[Nle]RKCEPD[Pra]DKCCRPNLVCSRTHQWCKYVF-{Amide} | [Leu5;Nle6;Glu10;Pra13;Gln28]GpTx-1(1-34) | 2629 |
| DCLGI[Nle]RKCEPD[Pra]DKCCRPNLVCSRTHQWCKYVF-{Amide} | [Ile5;Nle6;Glu10;Pra13;Gln28]GpTx-1(1-34) | 2630 |
| DCLGGFRKCDPD[Pra]DKCCRPNLVCSRTHQWCKYVF-{Amide} | [Gly5;Phe6;Asp10;Pra13;Gln28]GpTx-1(1-34) | 2631 |
| DCLGAFRKCDPD[Pra]DKCCRPNLVCSRTHQWCKYVF-{Amide} | [Ala5;Phe6;Asp10;Pra13;Gln28]GpTx-1(1-34) | 2632 |
| DCLG[2-Abu]FRKCDPD[Pra]DKCCRPNLVCSRTHQWCKYVF-{Amide} | [2-Abu5;Phe6;Asp10;Pra13;Gln28]GpTx-1(1-34) | 2633 |
| DCLG[Nva]FRKCDPD[Pra]DKCCRPNLVCSRTHQWCKYVF-{Amide} | [Nva5;Phe6;Asp10;Pra13;Gln28]GpTx-1(1-34) | 2634 |
| DCLG[Nle]FRKCDPD[Pra]DKCCRPNLVCSRTHQWCKYVF-{Amide} | [Nle5;Phe6;Asp10;Pra13;Gln28]GpTx-1(1-34) | 2635 |
| DCLGVFRKCDPD[Pra]DKCCRPNLVCSRTHQWCKYVF-{Amide} | [Val5;Phe6;Asp10;Pra13;Gln28]GpTx-1(1-34) | 2636 |
| DCLGLFRKCDPD[Pra]DKCCRPNLVCSRTHQWCKYVF-{Amide} | [Leu5;Phe6;Asp10;Pra13;Gln28]GpTx-1(1-34) | 2637 |
| DCLGIFRKCDPD[Pra]DKCCRPNLVCSRTHQWCKYVF-{Amide} | [Ile5;Phe6;Asp10;Pra13;Gln28]GpTx-1(1-34) | 2638 |
| DCLGGLRKCDPD[Pra]DKCCRPNLVCSRTHQWCKYVF-{Amide} | [Gly5;Leu6;Asp10;Pra13;Gln28]GpTx-1(1-34) | 2639 |
| DCLGALRKCDPD[Pra]DKCCRPNLVCSRTHQWCKYVF-{Amide} | [Ala5;Leu6;Asp10;Pra13;Gln28]GpTx-1(1-34) | 2640 |
| DCLG[2-Abu]LRKCDPD[Pra]DKCCRPNLVCSRTHQWCKYVF-{Amide} | [2-Abu5;Leu6;Asp10;Pra13;Gln28]GpTx-1(1-34) | 2641 |
| DCLG[Nva]LRKCDPD[Pra]DKCCRPNLVCSRTHQWCKYVF-{Amide} | [Nva5;Leu6;Asp10;Pra13;Gln28]GpTx-1(1-34) | 2642 |
| DCLG[Nle]LRKCDPD[Pra]DKCCRPNLVCSRTHQWCKYVF-{Amide} | [Nle5;Leu6;Asp10;Pra13;Gln28]GpTx-1(1-34) | 2643 |
| DCLGVLRKCDPD[Pra]DKCCRPNLVCSRTHQWCKYVF-{Amide} | [Val5;Leu6;Asp10;Pra13;Gln28]GpTx-1(1-34) | 2644 |
| DCLGLLRKCDPD[Pra]DKCCRPNLVCSRTHQWCKYVF-{Amide} | [Leu5,6;Asp10;Pra13;Gln28]GpTx-1(1-34) | 2645 |
| DCLGILRKCDPD[Pra]DKCCRPNLVCSRTHQWCKYVF-{Amide} | [Ile5;Leu6;Asp10;Pra13;Gln28]GpTx-1(1-34) | 2646 |
| DCLGG[Nle]RKCDPD[Pra]DKCCRPNLVCSRTHQWCKYVF-{Amide} | [Gly5;Nle6;Asp10;Pra13;Gln28]GpTx-1(1-34) | 2647 |
| DCLGA[Nle]RKCDPD[Pra]DKCCRPNLVCSRTHQWCKYVF-{Amide} | [Ala5;Nle6;Asp10;Pra13;Gln28]GpTx-1(1-34) | 2648 |
| DCLG[2-Abu][Nle]RKCDPD[Pra]DKCCRPNLVCSRTHQWCKYVF-{Amide} | [2-Abu5;Nle6;Asp10;Pra13;Gln28]GpTx-1(1-34) | 2649 |
| DCLG[Nva][Nle]RKCDPD[Pra]DKCCRPNLVCSRTHQWCKYVF-{Amide} | [Nva5;Nle6;Asp10;Pra13;Gln28]GpTx-1(1-34) | 2650 |
| DCLG[Nle][Nle]RKCDPD[Pra]DKCCRPNLVCSRTHQWCKYVF-{Amide} | [Nle5,6;Asp10;Pra13;Gln28]GpTx-1(1-34) | 2651 |
| DCLGV[Nle]RKCDPD[Pra]DKCCRPNLVCSRTHQWCKYVF-{Amide} | [Val5;Nle6;Asp10;Pra13;Gln28]GpTx-1(1-34) | 2652 |
| DCLGL[Nle]RKCDPD[Pra]DKCCRPNLVCSRTHQWCKYVF-{Amide} | [Leu5;Nle6;Asp10;Pra13;Gln28]GpTx-1(1-34) | 2653 |
| DCLGI[Nle]RKCDPD[Pra]DKCCRPNLVCSRTHQWCKYVF-{Amide} | [Ile5;Nle6;Asp10;Pra13;Gln28]GpTx-1(1-34) | 2654 |
| DCLGGFRKCIED[2-Abu]DKCCRPNLVCSRLHQWCKYVF-{Amide} | [Gly5;Phe6;Glu11;2-Abu13;Leu26;Gln28]GpTx-1(1-34) | 2655 |
| DCLGAFRKCIED[2-Abu]DKCCRPNLVCSRLHQWCKYVF-{Amide} | [Ala5;Phe6;Glu11;2-Abu13;Leu26;Gln28]GpTx-1(1-34) | 2656 |
| DCLG[2-Abu]FRKCIED[2-Abu]DKCCRPNLVCSRLHQWCKYVF-{Amide} | [2-Abu5,13;Phe6;Glu11;Leu26;Gln28]GpTx-1(1-34) | 2657 |
| DCLG[Nva]FRKCIED[2-Abu]DKCCRPNLVCSRLHQWCKYVF-{Amide} | [Nva5;Phe6;Glu11;2-Abu13;Leu26;Gln28]GpTx-1(1-34) | 2658 |
| DCLG[Nle]FRKCIED[2-Abu]DKCCRPNLVCSRLHQWCKYVF-{Amide} | [Nle5;Phe6;Glu11;2-Abu13;Leu26;Gln28]GpTx-1(1-34) | 2659 |
| DCLGVFRKCIED[2-Abu]DKCCRPNLVCSRLHQWCKYVF-{Amide} | [Val5;Phe6;Glu11;2-Abu13;Leu26;Gln28]GpTx-1(1-34) | 2660 |
| DCLGLFRKCIED[2-Abu]DKCCRPNLVCSRLHQWCKYVF-{Amide} | [Leu5,26;Phe6;Glu11;2-Abu13;Gln28]GpTx-1(1-34) | 2661 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGIFRKCIED[2-Abu]DKCCRPNLVCSRLHQWCKYVF-{Amide} | [Ile5;Phe6;Glu11;2-Abu13;Leu26;Gln28]GpTx-1(1-34) | 2662 |
| DCLGGLRKCIED[2-Abu]DKCCRPNLVCSRLHQWCKYVF-{Amide} | [Gly5;Leu6,26;Glu11;2-Abu13;Gln28]GpTx-1(1-34) | 2663 |
| DCLGALRKCIED[2-Abu]DKCCRPNLVCSRLHQWCKYVF-{Amide} | [Ala5;Leu6,26;Glu11;2-Abu13;Gln28]GpTx-1(1-34) | 2664 |
| DCLG[2-Abu]LRKCIED[2-Abu]DKCCRPNLVCSRLHQWCKYVF-{Amide} | [2-Abu5,13;Leu6,26;Glu11;Gln28]GpTx-1(1-34) | 2665 |
| DCLG[Nva]LRKCIED[2-Abu]DKCCRPNLVCSRLHQWCKYVF-{Amide} | [Nva5;Leu6,26;Glu11;2-Abu13;Gln28]GpTx-1(1-34) | 2666 |
| DCLG[Nle]LRKCIED[2-Abu]DKCCRPNLVCSRLHQWCKYVF-{Amide} | [Nle5;Leu6,26;Glu11;2-Abu13;Gln28]GpTx-1(1-34) | 2667 |
| DCLGVLRKCIED[2-Abu]DKCCRPNLVCSRLHQWCKYVF-{Amide} | [Val5;Leu6,26;Glu11;2-Abu13;Gln28]GpTx-1(1-34) | 2668 |
| DCLGLLRKCIED[2-Abu]DKCCRPNLVCSRLHQWCKYVF-{Amide} | [Leu5,6,26;Glu11;2-Abu13;Gln28]GpTx-1(1-34) | 2669 |
| DCLGILRKCIED[2-Abu]DKCCRPNLVCSRLHQWCKYVF-{Amide} | [Ile5;Leu6,26;Glu11;2-Abu13;Gln28]GpTx-1(1-34) | 2670 |
| DCLGG[Nle]RKCIED[2-Abu]DKCCRPNLVCSRLHQWCKYVF-{Amide} | [Gly5;Nle6;Glu11;2-Abu13;Leu26;Gln28]GpTx-1(1-34) | 2671 |
| DCLGA[Nle]RKCIED[2-Abu]DKCCRPNLVCSRLHQWCKYVF-{Amide} | [Ala5;Nle6;Glu11;2-Abu13;Leu26;Gln28]GpTx-1(1-34) | 2672 |
| DCLG[2-Abu][Nle]RKCIED[2-Abu]DKCCRPNLVCSRLHQWCKYVF-{Amide} | [2-Abu5,13;Nle6;Glu11;Leu26;Gln28]GpTx-1(1-34) | 2673 |
| DCLG[Nva][Nle]RKCIED[2-Abu]DKCCRPNLVCSRLHQWCKYVF-{Amide} | [Nva5;Nle6;Glu11;2-Abu13;Leu26;Gln28]GpTx-1(1-34) | 2674 |
| DCLG[Nle][Nle]RKCIED[2-Abu]DKCCRPNLVCSRLHQWCKYVF-{Amide} | [Nle5,6;Glu11;2-Abu13;Leu26;Gln28]GpTx-1(1-34) | 2675 |
| DCLGV[Nle]RKCIED[2-Abu]DKCCRPNLVCSRLHQWCKYVF-{Amide} | [Val5;Nle6;Glu11;2-Abu13;Leu26;Gln28]GpTx-1(1-34) | 2676 |
| DCLGL[Nle]RKCIED[2-Abu]DKCCRPNLVCSRLHQWCKYVF-{Amide} | [Leu5,26;Nle6;Glu11;2-Abu13;Gln28]GpTx-1(1-34) | 2677 |
| DCLGI[Nle]RKCIED[2-Abu]DKCCRPNLVCSRLHQWCKYVF-{Amide} | [Ile5;Nle6;Glu11;2-Abu13;Leu26;Gln28]GpTx-1(1-34) | 2678 |
| DCLGGFRKCEPD[2-Abu]DKCCRPNLVCSRLHQWCKYVF-{Amide} | [Gly5;Phe6;Glu10;2-Abu13;Leu26;Gln28]GpTx-1(1-34) | 2679 |
| DCLGAFRKCEPD[2-Abu]DKCCRPNLVCSRLHQWCKYVF-{Amide} | [Ala5;Phe6;Glu10;2-Abu13;Leu26;Gln28]GpTx-1(1-34) | 2680 |
| DCLG[2-Abu]FRKCEPD[2-Abu]DKCCRPNLVCSRLHQWCKYVF-{Amide} | [2-Abu5,13;Phe6;Glu10;Leu26;Gln28]GpTx-1(1-34) | 2681 |
| DCLG[Nva]FRKCEPD[2-Abu]DKCCRPNLVCSRLHQWCKYVF-{Amide} | [Nva5;Phe6;Glu10;2-Abu13;Leu26;Gln28]GpTx-1(1-34) | 2682 |
| DCLG[Nle]FRKCEPD[2-Abu]DKCCRPNLVCSRLHQWCKYVF-{Amide} | [Nle5;Phe6;Glu10;2-Abu13;Leu26;Gln28]GpTx-1(1-34) | 2683 |
| DCLGVFRKCEPD[2-Abu]DKCCRPNLVCSRLHQWCKYVF-{Amide} | [Val5;Phe6;Glu10;2-Abu13;Leu26;Gln28]GpTx-1(1-34) | 2684 |
| DCLGLFRKCEPD[2-Abu]DKCCRPNLVCSRLHQWCKYVF-{Amide} | [Leu5,26;Phe6;Glu10;2-Abu13;Gln28]GpTx-1(1-34) | 2685 |
| DCLGIFRKCEPD[2-Abu]DKCCRPNLVCSRLHQWCKYVF-{Amide} | [Ile5;Phe6;Glu10;2-Abu13;Leu26;Gln28]GpTx-1(1-34) | 2686 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGLRKCEPD[2-Abu]DKCCRPNLVCSRLHQWCKYVF-{Amide} | [Gly5;Leu6,26;Glu10;2-Abu13;Gln28]GpTx-1(1-34) | 2687 |
| DCLGALRKCEPD[2-Abu]DKCCRPNLVCSRLHQWCKYVF-{Amide} | [Ala5;Leu6,26;Glu10;2-Abu13;Gln28]GpTx-1(1-34) | 2688 |
| DCLG[2-Abu]LRKCEPD[2-Abu]DKCCRPNLVCSRLHQWCKYVF-{Amide} | [2-Abu5,13;Leu6,26;Glu10;Gln28]GpTx-1(1-34) | 2689 |
| DCLG[Nva]LRKCEPD[2-Abu]DKCCRPNLVCSRLHQWCKYVF-{Amide} | [Nva5;Leu6,26;Glu10;2-Abu13;Gln28]GpTx-1(1-34) | 2690 |
| DCLG[Nle]LRKCEPD[2-Abu]DKCCRPNLVCSRLHQWCKYVF-{Amide} | [Nle5;Leu6,26;Glu10;2-Abu13;Gln28]GpTx-1(1-34) | 2691 |
| DCLGVLRKCEPD[2-Abu]DKCCRPNLVCSRLHQWCKYVF-{Amide} | [Val5;Leu6,26;Glu10;2-Abu13;Gln28]GpTx-1(1-34) | 2692 |
| DCLGLLRKCEPD[2-Abu]DKCCRPNLVCSRLHQWCKYVF-{Amide} | [Leu5,6,26;Glu10;2-Abu13;Gln28]GpTx-1(1-34) | 2693 |
| DCLGILRKCEPD[2-Abu]DKCCRPNLVCSRLHQWCKYVF-{Amide} | [Ile5;Leu6,26;Glu10;2-Abu13;Gln28]GpTx-1(1-34) | 2694 |
| DCLGG[Nle]RKCEPD[2-Abu]DKCCRPNLVCSRLHQWCKYVF-{Amide} | [Gly5;Nle6;Glu10;2-Abu13;Leu26;Gln28]GpTx-1(1-34) | 2695 |
| DCLGA[Nle]RKCEPD[2-Abu]DKCCRPNLVCSRLHQWCKYVF-{Amide} | [Ala5;Nle6;Glu10;2-Abu13;Leu26;Gln28]GpTx-1(1-34) | 2696 |
| DCLG[2-Abu][Nle]RKCEPD[2-Abu]DKCCRPNLVCSRLHQWCKYVF-{Amide} | [2-Abu5,13;Nle6;Glu10;Leu26;Gln28]GpTx-1(1-34) | 2697 |
| DCLG[Nva][Nle]RKCEPD[2-Abu]DKCCRPNLVCSRLHQWCKYVF-{Amide} | [Nva5;Nle6;Glu10;2-Abu13;Leu26;Gln28]GpTx-1(1-34) | 2698 |
| DCLG[Nle][Nle]RKCEPD[2-Abu]DKCCRPNLVCSRLHQWCKYVF-{Amide} | [Nle5,6;Glu10;2-Abu13;Leu26;Gln28]GpTx-1(1-34) | 2699 |
| DCLGV[Nle]RKCEPD[2-Abu]DKCCRPNLVCSRLHQWCKYVF-{Amide} | [Val5;Nle6;Glu10;2-Abu13;Leu26;Gln28]GpTx-1(1-34) | 2700 |
| DCLGL[Nle]RKCEPD[2-Abu]DKCCRPNLVCSRLHQWCKYVF-{Amide} | [Leu5,26;Nle6;Glu10;2-Abu13;Gln28]GpTx-1(1-34) | 2701 |
| DCLGI[Nle]RKCEPD[2-Abu]DKCCRPNLVCSRLHQWCKYVF-{Amide} | [Ile5;Nle6;Glu10;2-Abu13;Leu26;Gln28]GpTx-1(1-34) | 2702 |
| DCLGGFRKCDPD[2-Abu]DKCCRPNLVCSRLHQWCKYVF-{Amide} | [Gly5;Phe6;Asp10;2-Abu13;Leu26;Gln28]GpTx-1(1-34) | 2703 |
| DCLGAFRKCDPD[2-Abu]DKCCRPNLVCSRLHQWCKYVF-{Amide} | [Ala5;Phe6;Asp10;2-Abu13;Leu26;Gln28]GpTx-1(1-34) | 2704 |
| DCLG[2-Abu]FRKCDPD[2-Abu]DKCCRPNLVCSRLHQWCKYVF-{Amide} | [2-Abu5,13;Phe6;Asp10;Leu26;Gln28]GpTx-1(1-34) | 2705 |
| DCLG[Nva]FRKCDPD[2-Abu]DKCCRPNLVCSRLHQWCKYVF-{Amide} | [Nva5;Phe6;Asp10;2-Abu13;Leu26;Gln28]GpTx-1(1-34) | 2706 |
| DCLG[Nle]FRKCDPD[2-Abu]DKCCRPNLVCSRLHQWCKYVF-{Amide} | [Nle5;Phe6;Asp10;2-Abu13;Leu26;Gln28]GpTx-1(1-34) | 2707 |
| DCLGVFRKCDPD[2-Abu]DKCCRPNLVCSRLHQWCKYVF-{Amide} | [Val5;Phe6;Asp10;2-Abu13;Leu26;Gln28]GpTx-1(1-34) | 2708 |
| DCLGLFRKCDPD[2-Abu]DKCCRPNLVCSRLHQWCKYVF-{Amide} | [Leu5,26;Phe6;Asp10;2-Abu13;Gln28]GpTx-1(1-34) | 2709 |
| DCLGIFRKCDPD[2-Abu]DKCCRPNLVCSRLHQWCKYVF-{Amide} | [Ile5;Phe6;Asp10;2-Abu13;Leu26;Gln28]GpTx-1(1-34) | 2710 |
| DCLGGLRKCDPD[2-Abu]DKCCRPNLVCSRLHQWCKYVF-{Amide} | [Gly5;Leu6,26;Asp10;2-Abu13;Gln28]GpTx-1(1-34) | 2711 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGALRKCDPD[2-Abu]DKCCRPNLVCSRLHQWCKYVF-{Amide} | [Ala5;Leu6,26;Asp10;2-Abu13;Gln28]GpTx-1(1-34) | 2712 |
| DCLG[2-Abu]LRKCDPD[2-Abu]DKCCRPNLVCSRLHQWCKYVF-{Amide} | [2-Abu5,13;Leu6,26;Asp10;Gln28]GpTx-1(1-34) | 2713 |
| DCLG[Nva]LRKCDPD[2-Abu]DKCCRPNLVCSRLHQWCKYVF-{Amide} | [Nva5;Leu6,26;Asp10;2-Abu13;Gln28]GpTx-1(1-34) | 2714 |
| DCLG[Nle]LRKCDPD[2-Abu]DKCCRPNLVCSRLHQWCKYVF-{Amide} | [Nle5;Leu6,26;Asp10;2-Abu13;Gln28]GpTx-1(1-34) | 2715 |
| DCLGVLRKCDPD[2-Abu]DKCCRPNLVCSRLHQWCKYVF-{Amide} | [Val5;Leu6,26;Asp10;2-Abu13;Gln28]GpTx-1(1-34) | 2716 |
| DCLGLLRKCDPD[2-Abu]DKCCRPNLVCSRLHQWCKYVF-{Amide} | [Leu5,6,26;Asp10;2-Abu13;Gln28]GpTx-1(1-34) | 2717 |
| DCLGILRKCDPD[2-Abu]DKCCRPNLVCSRLHQWCKYVF-{Amide} | [Ile5;Leu6,26;Asp10;2-Abu13;Gln28]GpTx-1(1-34) | 2718 |
| DCLGG[Nle]RKCDPD[2-Abu]DKCCRPNLVCSRLHQWCKYVF-{Amide} | [Gly5;Nle6;Asp10;2-Abu13;Leu26;Gln28]GpTx-1(1-34) | 2719 |
| DCLGA[Nle]RKCDPD[2-Abu]DKCCRPNLVCSRLHQWCKYVF-{Amide} | [Ala5;Nle6;Asp10;2-Abu13;Leu26;Gln28]GpTx-1(1-34) | 2720 |
| DCLG[2-Abu][Nle]RKCDPD[2-Abu]DKCCRPNLVCSRLHQWCKYVF-{Amide} | [2-Abu5,13;Nle6;Asp10;Leu26;Gln28]GpTx-1(1-34) | 2721 |
| DCLG[Nva][Nle]RKCDPD[2-Abu]DKCCRPNLVCSRLHQWCKYVF-{Amide} | [Nva5;Nle6;Asp10;2-Abu13;Leu26;Gln28]GpTx-1(1-34) | 2722 |
| DCLG[Nle][Nle]RKCDPD[2-Abu]DKCCRPNLVCSRLHQWCKYVF-{Amide} | [Nle5,6;Asp10;2-Abu13;Leu26;Gln28]GpTx-1(1-34) | 2723 |
| DCLGV[Nle]RKCDPD[2-Abu]DKCCRPNLVCSRLHQWCKYVF-{Amide} | [Val5;Nle6;Asp10;2-Abu13;Leu26;Gln28]GpTx-1(1-34) | 2724 |
| DCLGL[Nle]RKCDPD[2-Abu]DKCCRPNLVCSRLHQWCKYVF-{Amide} | [Leu5,26;Nle6;Asp10;2-Abu13;Gln28]GpTx-1(1-34) | 2725 |
| DCLGI[Nle]RKCDPD[2-Abu]DKCCRPNLVCSRLHQWCKYVF-{Amide} | [Ile5;Nle6;Asp10;2-Abu13;Leu26;Gln28]GpTx-1(1-34) | 2726 |
| DCLGGFRKCIED[Pra]DKCCRPNLVCSRLHQWCKYVF-{Amide} | [Gly5;Phe6;Glu11;Pra13;Leu26;Gln28]GpTx-1(1-34) | 2727 |
| DCLGAFRKCIED[Pra]DKCCRPNLVCSRLHQWCKYVF-{Amide} | [Ala5;Phe6;Glu11;Pra13;Leu26;Gln28]GpTx-1(1-34) | 2728 |
| DCLG[2-Abu]FRKCIED[Pra]DKCCRPNLVCSRLHQWCKYVF-{Amide} | [2-Abu5;Phe6;Glu11;Pra13;Leu26;Gln28]GpTx-1(1-34) | 2729 |
| DCLG[Nva]FRKCIED[Pra]DKCCRPNLVCSRLHQWCKYVF-{Amide} | [Nva5;Phe6;Glu11;Pra13;Leu26;Gln28]GpTx-1(1-34) | 2730 |
| DCLG[Nle]FRKCIED[Pra]DKCCRPNLVCSRLHQWCKYVF-{Amide} | [Nle5;Phe6;Glu11;Pra13;Leu26;Gln28]GpTx-1(1-34) | 2731 |
| DCLGVFRKCIED[Pra]DKCCRPNLVCSRLHQWCKYVF-{Amide} | [Val5;Phe6;Glu11;Pra13;Leu26;Gln28]GpTx-1(1-34) | 2732 |
| DCLGLFRKCIED[Pra]DKCCRPNLVCSRLHQWCKYVF-{Amide} | [Leu5,26;Phe6;Glu11;Pra13;Gln28]GpTx-1(1-34) | 2733 |
| DCLGIFRKCIED[Pra]DKCCRPNLVCSRLHQWCKYVF-{Amide} | [Ile5;Phe6;Glu11;Pra13;Leu26;Gln28]GpTx-1(1-34) | 2734 |
| DCLGGLRKCIED[Pra]DKCCRPNLVCSRLHQWCKYVF-{Amide} | [Gly5;Leu6,26;Glu11;Pra13;Gln28]GpTx-1(1-34) | 2735 |
| DCLGALRKCIED[Pra]DKCCRPNLVCSRLHQWCKYVF-{Amide} | [Ala5;Leu6,26;Glu11;Pra13;Gln28]GpTx-1(1-34) | 2736 |
| DCLG[2-Abu]LRKCIED[Pra]DKCCRPNLVCSRLHQWCKYVF-{Amide} | [2-Abu5;Leu6,26;Glu11;Pra13;Gln28]GpTx-1(1-34) | 2737 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nva]LRKCIED[Pra]DKCCRPNLVCSRLHQWCKYVF-{Amide} | [Nva5;Leu6,26;Glu11;Pra13;Gln28]GpTx-1(1-34) | 2738 |
| DCLG[Nle]LRKCIED[Pra]DKCCRPNLVCSRLHQWCKYVF-{Amide} | [Nle5;Leu6,26;Glu11;Pra13;Gln28]GpTx-1(1-34) | 2739 |
| DCLGVLRKCIED[Pra]DKCCRPNLVCSRLHQWCKYVF-{Amide} | [Val5;Leu6,26;Glu11;Pra13;Gln28]GpTx-1(1-34) | 2740 |
| DCLGLLRKCIED[Pra]DKCCRPNLVCSRLHQWCKYVF-{Amide} | [Leu5,6,26;Glu11;Pra13;Gln28]GpTx-1(1-34) | 2741 |
| DCLGILRKCIED[Pra]DKCCRPNLVCSRLHQWCKYVF-{Amide} | [Ile5;Leu6,26;Glu11;Pra13;Gln28]GpTx-1(1-34) | 2742 |
| DCLGG[Nle]RKCIED[Pra]DKCCRPNLVCSRLHQWCKYVF-{Amide} | [Gly5;Nle6;Glu11;Pra13;Leu26;Gln28]GpTx-1(1-34) | 2743 |
| DCLGA[Nle]RKCIED[Pra]DKCCRPNLVCSRLHQWCKYVF-{Amide} | [Ala5;Nle6;Glu11;Pra13;Leu26;Gln28]GpTx-1(1-34) | 2744 |
| DCLG[2-Abu][Nle]RKCIED[Pra]DKCCRPNLVCSRLHQWCKYVF-{Amide} | [2-Abu5;Nle6;Glu11;Pra13;Leu26;Gln28]GpTx-1(1-34) | 2745 |
| DCLG[Nva][Nle]RKCIED[Pra]DKCCRPNLVCSRLHQWCKYVF-{Amide} | [Nva5;Nle6;Glu11;Pra13;Leu26;Gln28]GpTx-1(1-34) | 2746 |
| DCLG[Nle][Nle]RKCIED[Pra]DKCCRPNLVCSRLHQWCKYVF-{Amide} | [Nle5,6;Glu11;Pra13;Leu26;Gln28]GpTx-1(1-34) | 2747 |
| DCLGV[Nle]RKCIED[Pra]DKCCRPNLVCSRLHQWCKYVF-{Amide} | [Val5;Nle6;Glu11;Pra13;Leu26;Gln28]GpTx-1(1-34) | 2748 |
| DCLGL[Nle]RKCIED[Pra]DKCCRPNLVCSRLHQWCKYVF-{Amide} | [Leu5,26;Nle6;Glu11;Pra13;Gln28]GpTx-1(1-34) | 2749 |
| DCLGI[Nle]RKCIED[Pra]DKCCRPNLVCSRLHQWCKYVF-{Amide} | [Ile5;Nle6;Glu11;Pra13;Leu26;Gln28]GpTx-1(1-34) | 2750 |
| DCLGGFRKCEPD[Pra]DKCCRPNLVCSRLHQWCKYVF-{Amide} | [Gly5;Phe6;Glu10;Pra13;Leu26;Gln28]GpTx-1(1-34) | 2751 |
| DCLGAFRKCEPD[Pra]DKCCRPNLVCSRLHQWCKYVF-{Amide} | [Ala5;Phe6;Glu10;Pra13;Leu26;Gln28]GpTx-1(1-34) | 2752 |
| DCLG[2-Abu]FRKCEPD[Pra]DKCCRPNLVCSRLHQWCKYVF-{Amide} | [2-Abu5;Phe6;Glu10;Pra13;Leu26;Gln28]GpTx-1(1-34) | 2753 |
| DCLG[Nva]FRKCEPD[Pra]DKCCRPNLVCSRLHQWCKYVF-{Amide} | [Nva5;Phe6;Glu10;Pra13;Leu26;Gln28]GpTx-1(1-34) | 2754 |
| DCLG[Nle]FRKCEPD[Pra]DKCCRPNLVCSRLHQWCKYVF-{Amide} | [Nle5;Phe6;Glu10;Pra13;Leu26;Gln28]GpTx-1(1-34) | 2755 |
| DCLGVFRKCEPD[Pra]DKCCRPNLVCSRLHQWCKYVF-{Amide} | [Val5;Phe6;Glu10;Pra13;Leu26;Gln28]GpTx-1(1-34) | 2756 |
| DCLGLFRKCEPD[Pra]DKCCRPNLVCSRLHQWCKYVF-{Amide} | [Leu5,26;Phe6;Glu10;Pra13;Gln28]GpTx-1(1-34) | 2757 |
| DCLGIFRKCEPD[Pra]DKCCRPNLVCSRLHQWCKYVF-{Amide} | [Ile5;Phe6;Glu10;Pra13;Leu26;Gln28]GpTx-1(1-34) | 2758 |
| DCLGGLRKCEPD[Pra]DKCCRPNLVCSRLHQWCKYVF-{Amide} | [Gly5;Leu6,26;Glu10;Pra13;Gln28]GpTx-1(1-34) | 2759 |
| DCLGALRKCEPD[Pra]DKCCRPNLVCSRLHQWCKYVF-{Amide} | [Ala5;Leu6,26;Glu10;Pra13;Gln28]GpTx-1(1-34) | 2760 |
| DCLG[2-Abu]LRKCEPD[Pra]DKCCRPNLVCSRLHQWCKYVF-{Amide} | [2-Abu5;Leu6,26;Glu10;Pra13;Gln28]GpTx-1(1-34) | 2761 |
| DCLG[Nva]LRKCEPD[Pra]DKCCRPNLVCSRLHQWCKYVF-{Amide} | [Nva5;Leu6,26;Glu10;Pra13;Gln28]GpTx-1(1-34) | 2762 |
| DCLG[Nle]LRKCEPD[Pra]DKCCRPNLVCSRLHQWCKYVF-{Amide} | [Nle5;Leu6,26;Glu10;Pra13;Gln28]GpTx-1(1-34) | 2763 |
| DCLGVLRKCEPD[Pra]DKCCRPNLVCSRLHQWCKYVF-{Amide} | [Val5;Leu6,26;Glu10;Pra13;Gln28]GpTx-1(1-34) | 2764 |
| DCLGLLRKCEPD[Pra]DKCCRPNLVCSRLHQWCKYVF-{Amide} | [Leu5,6,26;Glu10;Pra13;Gln28]GpTx-1(1-34) | 2765 |
| DCLGILRKCEPD[Pra]DKCCRPNLVCSRLHQWCKYVF-{Amide} | [Ile5;Leu6,26;Glu10;Pra13;Gln28]GpTx-1(1-34) | 2766 |
| DCLGG[Nle]RKCEPD[Pra]DKCCRPNLVCSRLHQWCKYVF-{Amide} | [Gly5;Nle6;Glu10;Pra13;Leu26;Gln28]GpTx-1(1-34) | 2767 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGA[Nle]RKCEPD[Pra]DKCCRPNLVCSRLHQWCKYVF-{Amide} | [Ala5;Nle6;Glu10;Pra13;Leu26;Gln28]GpTx-1(1-34) | 2768 |
| DCLG[2-Abu][Nle]RKCEPD[Pra]DKCCRPNLVCSRLHQWCKYVF-{Amide} | [2-Abu5;Nle6;Glu10;Pra13;Leu26;Gln28]GpTx-1(1-34) | 2769 |
| DCLG[Nva][Nle]RKCEPD[Pra]DKCCRPNLVCSRLHQWCKYVF-{Amide} | [Nva5;Nle6;Glu10;Pra13;Leu26;Gln28]GpTx-1(1-34) | 2770 |
| DCLG[Nle][Nle]RKCEPD[Pra]DKCCRPNLVCSRLHQWCKYVF-{Amide} | [Nle5,6;Glu10;Pra13;Leu26;Gln28]GpTx-1(1-34) | 2771 |
| DCLGV[Nle]RKCEPD[Pra]DKCCRPNLVCSRLHQWCKYVF-{Amide} | [Val5;Nle6;Glu10;Pra13;Leu26;Gln28]GpTx-1(1-34) | 2772 |
| DCLGL[Nle]RKCEPD[Pra]DKCCRPNLVCSRLHQWCKYVF-{Amide} | [Leu5,26;Nle6;Glu10;Pra13;Gln28]GpTx-1(1-34) | 2773 |
| DCLGI[Nle]RKCEPD[Pra]DKCCRPNLVCSRLHQWCKYVF-{Amide} | [Ile5;Nle6;Glu10;Pra13;Leu26;Gln28]GpTx-1(1-34) | 2774 |
| DCLGGFRKCDPD[Pra]DKCCRPNLVCSRLHQWCKYVF-{Amide} | [Gly5;Phe6;Asp10;Pra13;Leu26;Gln28]GpTx-1(1-34) | 2775 |
| DCLGAFRKCDPD[Pra]DKCCRPNLVCSRLHQWCKYVF-{Amide} | [Ala5;Phe6;Asp10;Pra13;Leu26;Gln28]GpTx-1(1-34) | 2776 |
| DCLG[2-Abu]FRKCDPD[Pra]DKCCRPNLVCSRLHQWCKYVF-{Amide} | [2-Abu5;Phe6;Asp10;Pra13;Leu26;Gln28]GpTx-1(1-34) | 2777 |
| DCLG[Nva]FRKCDPD[Pra]DKCCRPNLVCSRLHQWCKYVF-{Amide} | [Nva5;Phe6;Asp10;Pra13;Leu26;Gln28]GpTx-1(1-34) | 2778 |
| DCLG[Nle]FRKCDPD[Pra]DKCCRPNLVCSRLHQWCKYVF-{Amide} | [Nle5;Phe6;Asp10;Pra13;Leu26;Gln28]GpTx-1(1-34) | 2779 |
| DCLGVFRKCDPD[Pra]DKCCRPNLVCSRLHQWCKYVF-{Amide} | [Val5;Phe6;Asp10;Pra13;Leu26;Gln28]GpTx-1(1-34) | 2780 |
| DCLGLFRKCDPD[Pra]DKCCRPNLVCSRLHQWCKYVF-{Amide} | [Leu5,26;Phe6;Asp10;Pra13;Gln28]GpTx-1(1-34) | 2781 |
| DCLGIFRKCDPD[Pra]DKCCRPNLVCSRLHQWCKYVF-{Amide} | [Ile5;Phe6;Asp10;Pra13;Leu26;Gln28]GpTx-1(1-34) | 2782 |
| DCLGGLRKCDPD[Pra]DKCCRPNLVCSRLHQWCKYVF-{Amide} | [Gly5;Leu6,26;Asp10;Pra13;Gln28]GpTx-1(1-34) | 2783 |
| DCLGALRKCDPD[Pra]DKCCRPNLVCSRLHQWCKYVF-{Amide} | [Ala5;Leu6,26;Asp10;Pra13;Gln28]GpTx-1(1-34) | 2784 |
| DCLG[2-Abu]LRKCDPD[Pra]DKCCRPNLVCSRLHQWCKYVF-{Amide} | [2-Abu5;Leu6,26;Asp10;Pra13;Gln28]GpTx-1(1-34) | 2785 |
| DCLG[Nva]LRKCDPD[Pra]DKCCRPNLVCSRLHQWCKYVF-{Amide} | [Nva5;Leu6,26;Asp10;Pra13;Gln28]GpTx-1(1-34) | 2786 |
| DCLG[Nle]LRKCDPD[Pra]DKCCRPNLVCSRLHQWCKYVF-{Amide} | [Nle5;Leu6,26;Asp10;Pra13;Gln28]GpTx-1(1-34) | 2787 |
| DCLGVLRKCDPD[Pra]DKCCRPNLVCSRLHQWCKYVF-{Amide} | [Val5;Leu6,26;Asp10;Pra13;Gln28]GpTx-1(1-34) | 2788 |
| DCLGLLRKCDPD[Pra]DKCCRPNLVCSRLHQWCKYVF-{Amide} | [Leu5,6,26;Asp10;Pra13;Gln28]GpTx-1(1-34) | 2789 |
| DCLGILRKCDPD[Pra]DKCCRPNLVCSRLHQWCKYVF-{Amide} | [Ile5;Leu6,26;Asp10;Pra13;Gln28]GpTx-1(1-34) | 2790 |
| DCLGG[Nle]RKCDPD[Pra]DKCCRPNLVCSRLHQWCKYVF-{Amide} | [Gly5;Nle6;Asp10;Pra13;Leu26;Gln28]GpTx-1(1-34) | 2791 |
| DCLGA[Nle]RKCDPD[Pra]DKCCRPNLVCSRLHQWCKYVF-{Amide} | [Ala5;Nle6;Asp10;Pra13;Leu26;Gln28]GpTx-1(1-34) | 2792 |
| DCLG[2-Abu][Nle]RKCDPD[Pra]DKCCRPNLVCSRLHQWCKYVF-{Amide} | [2-Abu5;Nle6;Asp10;Pra13;Leu26;Gln28]GpTx-1(1-34) | 2793 |
| DCLG[Nva][Nle]RKCDPD[Pra]DKCCRPNLVCSRLHQWCKYVF-{Amide} | [Nva5;Nle6;Asp10;Pra13;Leu26;Gln28]GpTx-1(1-34) | 2794 |
| DCLG[Nle][Nle]RKCDPD[Pra]DKCCRPNLVCSRLHQWCKYVF-{Amide} | [Nle5,6;Asp10;Pra13;Leu26;Gln28]GpTx-1(1-34) | 2795 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGV[Nle]RKCDPD[Pra]DKCCRPNLVCSRLHQWCKYVF-{Amide} | [Val5;Nle6;Asp10;Pra13;Leu26;Gln28]GpTx-1(1-34) | 2796 |
| DCLGL[Nle]RKCDPD[Pra]DKCCRPNLVCSRLHQWCKYVF-{Amide} | [Leu5,26;Nle6;Asp10;Pra13;Gln28]GpTx-1(1-34) | 2797 |
| DCLGI[Nle]RKCDPD[Pra]DKCCRPNLVCSRLHQWCKYVF-{Amide} | [Ile5;Nle6;Asp10;Pra13;Leu26;Gln28]GpTx-1(1-34) | 2798 |
| DCLGFMRKCIPD[2-Abu]DKCCRPNLVCSREHKWCKYVF-{Amide} | [2-Abu13;Glu26]GpTx-1(1-34) | 2799 |
| DCLGFMRKCIPD[Pra]DKCCRPNLVCSREHKWCKYVF-{Amide} | [Pra13;Glu26]GpTx-1(1-34) | 2800 |
| DCLGFMRKCIED[2-Abu]DKCCRPNLVCSREHKWCKYVF-{Amide} | [Glu11,26;2-Abu13]GpTx-1(1-34) | 2801 |
| DCLGFMRKCEPD[2-Abu]DKCCRPNLVCSREHKWCKYVF-{Amide} | [Glu10,26;2-Abu13]GpTx-1(1-34) | 2802 |
| DCLGFMRKCDPD[2-Abu]DKCCRPNLVCSREHKWCKYVF-{Amide} | [Asp10;2-Abu13;Glu26]GpTx-1(1-34) | 2803 |
| DCLGFFRKCIPD[2-Abu]DKCCRPNLVCSREHKWCKYVF-{Amide} | [Phe6;2-Abu13;Glu26]GpTx-1(1-34) | 2804 |
| DCLGFLRKCIPD[2-Abu]DKCCRPNLVCSREHKWCKYVF-{Amide} | [Leu6;2-Abu13;Glu26]GpTx-1(1-34) | 2805 |
| DCLGF[Nle]RKCIPD[2-Abu]DKCCRPNLVCSREHKWCKYVF-{Amide} | [Nle6;2-Abu13;Glu26]GpTx-1(1-34) | 2806 |
| DCLGGMRKCIPD[2-Abu]DKCCRPNLVCSREHKWCKYVF-{Amide} | [Gly5;2-Abu13;Glu26]GpTx-1(1-34) | 2807 |
| DCLGAMRKCIPD[2-Abu]DKCCRPNLVCSREHKWCKYVF-{Amide} | [Ala5;2-Abu13;Glu26]GpTx-1(1-34) | 2808 |
| DCLG[2-Abu]MRKCIPD[2-Abu]DKCCRPNLVCSREHKWCKYVF-{Amide} | [2-Abu5,13;Glu26]GpTx-1(1-34) | 2809 |
| DCLG[Nva]MRKCIPD[2-Abu]DKCCRPNLVCSREHKWCKYVF-{Amide} | [Nva5;2-Abu13;Glu26]GpTx-1(1-34) | 2810 |
| DCLG[Nle]MRKCIPD[2-Abu]DKCCRPNLVCSREHKWCKYVF-{Amide} | [Nle5;2-Abu13;Glu26]GpTx-1(1-34) | 2811 |
| DCLGVMRKCIPD[2-Abu]DKCCRPNLVCSREHKWCKYVF-{Amide} | [Val5;2-Abu13;Glu26]GpTx-1(1-34) | 2812 |
| DCLGLMRKCIPD[2-Abu]DKCCRPNLVCSREHKWCKYVF-{Amide} | [Leu5;2-Abu13;Glu26]GpTx-1(1-34) | 2813 |
| DCLGIMRKCIPD[2-Abu]DKCCRPNLVCSREHKWCKYVF-{Amide} | [Ile5;2-Abu13;Glu26]GpTx-1(1-34) | 2814 |
| DCLGFMRKCIED[Pra]DKCCRPNLVCSREHKWCKYVF-{Amide} | [Glu11,26;Pra13]GpTx-1(1-34) | 2815 |
| DCLGFMRKCEPD[Pra]DKCCRPNLVCSREHKWCKYVF-{Amide} | [Glu10,26;Pra13]GpTx-1(1-34) | 2816 |
| DCLGFMRKCDPD[Pra]DKCCRPNLVCSREHKWCKYVF-{Amide} | [Asp10;Pra13;Glu26]GpTx-1(1-34) | 2817 |
| DCLGFFRKCIPD[Pra]DKCCRPNLVCSREHKWCKYVF-{Amide} | [Phe6;Pra13;Glu26]GpTx-1(1-34) | 2818 |
| DCLGFLRKCIPD[Pra]DKCCRPNLVCSREHKWCKYVF-{Amide} | [Leu6;Pra13;Glu26]GpTx-1(1-34) | 2819 |
| DCLGF[Nle]RKCIPD[Pra]DKCCRPNLVCSREHKWCKYVF-{Amide} | [Nle6;Pra13;Glu26]GpTx-1(1-34) | 2820 |
| DCLGGMRKCIPD[Pra]DKCCRPNLVCSREHKWCKYVF-{Amide} | [Gly5;Pra13;Glu26]GpTx-1(1-34) | 2821 |
| DCLGAMRKCIPD[Pra]DKCCRPNLVCSREHKWCKYVF-{Amide} | [Ala5;Pra13;Glu26]GpTx-1(1-34) | 2822 |
| DCLG[2-Abu]MRKCIPD[Pra]DKCCRPNLVCSREHKWCKYVF-{Amide} | [2-Abu5;Pra13;Glu26]GpTx-1(1-34) | 2823 |
| DCLG[Nva]MRKCIPD[Pra]DKCCRPNLVCSREHKWCKYVF-{Amide} | [Nva5;Pra13;Glu26]GpTx-1(1-34) | 2824 |
| DCLG[Nle]MRKCIPD[Pra]DKCCRPNLVCSREHKWCKYVF-{Amide} | [Nle5;Pra13;Glu26]GpTx-1(1-34) | 2825 |
| DCLGVMRKCIPD[Pra]DKCCRPNLVCSREHKWCKYVF-{Amide} | [Val5;Pra13;Glu26]GpTx-1(1-34) | 2826 |
| DCLGLMRKCIPD[Pra]DKCCRPNLVCSREHKWCKYVF-{Amide} | [Leu5;Pra13;Glu26]GpTx-1(1-34) | 2827 |
| DCLGIMRKCIPD[Pra]DKCCRPNLVCSREHKWCKYVF-{Amide} | [Ile5;Pra13;Glu26]GpTx-1(1-34) | 2828 |
| DCLGFFRKCIED[2-Abu]DKCCRPNLVCSREHKWCKYVF-{Amide} | [Phe6;Glu11,26;2-Abu13]GpTx-1(1-34) | 2829 |
| DCLGFLRKCIED[2-Abu]DKCCRPNLVCSREHKWCKYVF-{Amide} | [Leu6;Glu11,26;2-Abu13]GpTx-1(1-34) | 2830 |
| DCLGF[Nle]RKCIED[2-Abu]DKCCRPNLVCSREHKWCKYVF-{Amide} | [Nle6;Glu11,26;2-Abu13]GpTx-1(1-34) | 2831 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGMRKCIED[2-Abu]DKCCRPNLVCSREHKWCKYVF-{Amide} | [Gly5;Glu11,26;2-Abu13]GpTx-1(1-34) | 2832 |
| DCLGAMRKCIED[2-Abu]DKCCRPNLVCSREHKWCKYVF-{Amide} | [Ala5;Glu11,26;2-Abu13]GpTx-1(1-34) | 2833 |
| DCLG[2-Abu]MRKCIED[2-Abu]DKCCRPNLVCSREHKWCKYVF-{Amide} | [2-Abu5,13;Glu11,26]GpTx-1(1-34) | 2834 |
| DCLG[Nva]MRKCIED[2-Abu]DKCCRPNLVCSREHKWCKYVF-{Amide} | [Nva5;Glu11,26;2-Abu13]GpTx-1(1-34) | 2835 |
| DCLG[Nle]MRKCIED[2-Abu]DKCCRPNLVCSREHKWCKYVF-{Amide} | [Nle5;Glu11,26;2-Abu13]GpTx-1(1-34) | 2836 |
| DCLGVMRKCIED[2-Abu]DKCCRPNLVCSREHKWCKYVF-{Amide} | [Val5;Glu11,26;2-Abu13]GpTx-1(1-34) | 2837 |
| DCLGLMRKCIED[2-Abu]DKCCRPNLVCSREHKWCKYVF-{Amide} | [Leu5;Glu11,26;2-Abu13]GpTx-1(1-34) | 2838 |
| DCLGIMRKCIED[2-Abu]DKCCRPNLVCSREHKWCKYVF-{Amide} | [Ile5;Glu11,26;2-Abu13]GpTx-1(1-34) | 2839 |
| DCLGFFRKCEPD[2-Abu]DKCCRPNLVCSREHKWCKYVF-{Amide} | [Phe6;Glu10,26;2-Abu13]GpTx-1(1-34) | 2840 |
| DCLGFLRKCEPD[2-Abu]DKCCRPNLVCSREHKWCKYVF-{Amide} | [Leu6;Glu10,26;2-Abu13]GpTx-1(1-34) | 2841 |
| DCLGF[Nle]RKCEPD[2-Abu]DKCCRPNLVCSREHKWCKYVF-{Amide} | [Nle6;Glu10,26;2-Abu13]GpTx-1(1-34) | 2842 |
| DCLGGMRKCEPD[2-Abu]DKCCRPNLVCSREHKWCKYVF-{Amide} | [Gly5;Glu10,26;2-Abu13]GpTx-1(1-34) | 2843 |
| DCLGAMRKCEPD[2-Abu]DKCCRPNLVCSREHKWCKYVF-{Amide} | [Ala5;Glu10,26;2-Abu13]GpTx-1(1-34) | 2844 |
| DCLG[2-Abu]MRKCEPD[2-Abu]DKCCRPNLVCSREHKWCKYVF-{Amide} | [2-Abu5,13;Glu10,26]GpTx-1(1-34) | 2845 |
| DCLG[Nva]MRKCEPD[2-Abu]DKCCRPNLVCSREHKWCKYVF-{Amide} | [Nva5;Glu10,26;2-Abu13]GpTx-1(1-34) | 2846 |
| DCLG[Nle]MRKCEPD[2-Abu]DKCCRPNLVCSREHKWCKYVF-{Amide} | [Nle5;Glu10,26;2-Abu13]GpTx-1(1-34) | 2847 |
| DCLGVMRKCEPD[2-Abu]DKCCRPNLVCSREHKWCKYVF-{Amide} | [Val5;Glu10,26;2-Abu13]GpTx-1(1-34) | 2848 |
| DCLGLMRKCEPD[2-Abu]DKCCRPNLVCSREHKWCKYVF-{Amide} | [Leu5;Glu10,26;2-Abu13]GpTx-1(1-34) | 2849 |
| DCLGIMRKCEPD[2-Abu]DKCCRPNLVCSREHKWCKYVF-{Amide} | [Ile5;Glu10,26;2-Abu13]GpTx-1(1-34) | 2850 |
| DCLGFFRKCDPD[2-Abu]DKCCRPNLVCSREHKWCKYVF-{Amide} | [Phe6;Asp10;2-Abu13;Glu26]GpTx-1(1-34) | 2851 |
| DCLGFLRKCDPD[2-Abu]DKCCRPNLVCSREHKWCKYVF-{Amide} | [Leu6;Asp10;2-Abu13;Glu26]GpTx-1(1-34) | 2852 |
| DCLGF[Nle]RKCDPD[2-Abu]DKCCRPNLVCSREHKWCKYVF-{Amide} | [Nle6;Asp10;2-Abu13;Glu26]GpTx-1(1-34) | 2853 |
| DCLGGMRKCDPD[2-Abu]DKCCRPNLVCSREHKWCKYVF-{Amide} | [Gly5;Asp10;2-Abu13;Glu26]GpTx-1(1-34) | 2854 |
| DCLGAMRKCDPD[2-Abu]DKCCRPNLVCSREHKWCKYVF-{Amide} | [Ala5;Asp10;2-Abu13;Glu26]GpTx-1(1-34) | 2855 |
| DCLG[2-Abu]MRKCDPD[2-Abu]DKCCRPNLVCSREHKWCKYVF-{Amide} | [2-Abu5,13;Asp10;Glu26]GpTx-1(1-34) | 2856 |
| DCLG[Nva]MRKCDPD[2-Abu]DKCCRPNLVCSREHKWCKYVF-{Amide} | [Nva5;Asp10;2-Abu13;Glu26]GpTx-1(1-34) | 2857 |
| DCLG[Nle]MRKCDPD[2-Abu]DKCCRPNLVCSREHKWCKYVF-{Amide} | [Nle5;Asp10;2-Abu13;Glu26]GpTx-1(1-34) | 2858 |
| DCLGVMRKCDPD[2-Abu]DKCCRPNLVCSREHKWCKYVF-{Amide} | [Val5;Asp10;2-Abu13;Glu26]GpTx-1(1-34) | 2859 |
| DCLGLMRKCDPD[2-Abu]DKCCRPNLVCSREHKWCKYVF-{Amide} | [Leu5;Asp10;2-Abu13;Glu26]GpTx-1(1-34) | 2860 |
| DCLGIMRKCDPD[2-Abu]DKCCRPNLVCSREHKWCKYVF-{Amide} | [Ile5;Asp10;2-Abu13;Glu26]GpTx-1(1-34) | 2861 |
| DCLGGFRKCIPD[2-Abu]DKCCRPNLVCSREHKWCKYVF-{Amide} | [Gly5;Phe6;2-Abu13;Glu26]GpTx-1(1-34) | 2862 |
| DCLGAFRKCIPD[2-Abu]DKCCRPNLVCSREHKWCKYVF-{Amide} | [Ala5;Phe6;2-Abu13;Glu26]GpTx-1(1-34) | 2863 |
| DCLG[2-Abu]FRKCIPD[2-Abu]DKCCRPNLVCSREHKWCKYVF-{Amide} | [2-Abu5,13;Phe6;Glu26]GpTx-1(1-34) | 2864 |
| DCLG[Nva]FRKCIPD[2-Abu]DKCCRPNLVCSREHKWCKYVF-{Amide} | [Nva5;Phe6;2-Abu13;Glu26]GpTx-1(1-34) | 2865 |
| DCLG[Nle]FRKCIPD[2-Abu]DKCCRPNLVCSREHKWCKYVF-{Amide} | [Nle5;Phe6;2-Abu13;Glu26]GpTx-1(1-34) | 2866 |
| DCLGVFRKCIPD[2-Abu]DKCCRPNLVCSREHKWCKYVF-{Amide} | [Val5;Phe6;2-Abu13;Glu26]GpTx-1(1-34) | 2867 |
| DCLGLFRKCIPD[2-Abu]DKCCRPNLVCSREHKWCKYVF-{Amide} | [Leu5;Phe6;2-Abu13;Glu26]GpTx-1(1-34) | 2868 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGIFRKCIPD[2-Abu]DKCCRPNLVCSREHKWCKYVF-{Amide} | [Ile5;Phe6;2-Abu13;Glu26]GpTx-1(1-34) | 2869 |
| DCLGGLRKCIPD[2-Abu]DKCCRPNLVCSREHKWCKYVF-{Amide} | [Gly5;Leu6;2-Abu13;Glu26]GpTx-1(1-34) | 2870 |
| DCLGALRKCIPD[2-Abu]DKCCRPNLVCSREHKWCKYVF-{Amide} | [Ala5;Leu6;2-Abu13;Glu26]GpTx-1(1-34) | 2871 |
| DCLG[2-Abu]LRKCIPD[2-Abu]DKCCRPNLVCSREHKWCKYVF-{Amide} | [2-Abu5,13;Leu6;Glu26]GpTx-1(1-34) | 2872 |
| DCLG[Nva]LRKCIPD[2-Abu]DKCCRPNLVCSREHKWCKYVF-{Amide} | [Nva5;Leu6;2-Abu13;Glu26]GpTx-1(1-34) | 2873 |
| DCLG[Nle]LRKCIPD[2-Abu]DKCCRPNLVCSREHKWCKYVF-{Amide} | [Nle5;Leu6;2-Abu13;Glu26]GpTx-1(1-34) | 2874 |
| DCLGVLRKCIPD[2-Abu]DKCCRPNLVCSREHKWCKYVF-{Amide} | [Val5;Leu6;2-Abu13;Glu26]GpTx-1(1-34) | 2875 |
| DCLGLLRKCIPD[2-Abu]DKCCRPNLVCSREHKWCKYVF-{Amide} | [Leu5,6;2-Abu13;Glu26]GpTx-1(1-34) | 2876 |
| DCLGILRKCIPD[2-Abu]DKCCRPNLVCSREHKWCKYVF-{Amide} | [Ile5;Leu6;2-Abu13;Glu26]GpTx-1(1-34) | 2877 |
| DCLGG[Nle]RKCIPD[2-Abu]DKCCRPNLVCSREHKWCKYVF-{Amide} | [Gly5;Nle6;2-Abu13;Glu26]GpTx-1(1-34) | 2878 |
| DCLGA[Nle]RKCIPD[2-Abu]DKCCRPNLVCSREHKWCKYVF-{Amide} | [Ala5;Nle6;2-Abu13;Glu26]GpTx-1(1-34) | 2879 |
| DCLG[2-Abu][Nle]RKCIPD[2-Abu]DKCCRPNLVCSREHKWCKYVF-{Amide} | [2-Abu5,13;Nle6;Glu26]GpTx-1(1-34) | 2880 |
| DCLG[Nva][Nle]RKCIPD[2-Abu]DKCCRPNLVCSREHKWCKYVF-{Amide} | [Nva5;Nle6;2-Abu13;Glu26]GpTx-1(1-34) | 2881 |
| DCLG[Nle][Nle]RKCIPD[2-Abu]DKCCRPNLVCSREHKWCKYVF-{Amide} | [Nle5,6;2-Abu13;Glu26]GpTx-1(1-34) | 2882 |
| DCLGV[Nle]RKCIPD[2-Abu]DKCCRPNLVCSREHKWCKYVF-{Amide} | [Val5;Nle6;2-Abu13;Glu26]GpTx-1(1-34) | 2883 |
| DCLGL[Nle]RKCIPD[2-Abu]DKCCRPNLVCSREHKWCKYVF-{Amide} | [Leu5;Nle6;2-Abu13;Glu26]GpTx-1(1-34) | 2884 |
| DCLGI[Nle]RKCIPD[2-Abu]DKCCRPNLVCSREHKWCKYVF-{Amide} | [Ile5;Nle6;2-Abu13;Glu26]GpTx-1(1-34) | 2885 |
| DCLGFFRKCIED[Pra]DKCCRPNLVCSREHKWCKYVF-{Amide} | [Phe6;Glu11,26;Pra13]GpTx-1(1-34) | 2886 |
| DCLGFLRKCIED[Pra]DKCCRPNLVCSREHKWCKYVF-{Amide} | [Leu6;Glu11,26;Pra13]GpTx-1(1-34) | 2887 |
| DCLGF[Nle]RKCIED[Pra]DKCCRPNLVCSREHKWCKYVF-{Amide} | [Nle6;Glu11,26;Pra13]GpTx-1(1-34) | 2888 |
| DCLGGMRKCIED[Pra]DKCCRPNLVCSREHKWCKYVF-{Amide} | [Gly5;Glu11,26;Pra13]GpTx-1(1-34) | 2889 |
| DCLGAMRKCIED[Pra]DKCCRPNLVCSREHKWCKYVF-{Amide} | [Ala5;Glu11,26;Pra13]GpTx-1(1-34) | 2890 |
| DCLG[2-Abu]MRKCIED[Pra]DKCCRPNLVCSREHKWCKYVF-{Amide} | [2-Abu5;Glu11,26;Pra13]GpTx-1(1-34) | 2891 |
| DCLG[Nva]MRKCIED[Pra]DKCCRPNLVCSREHKWCKYVF-{Amide} | [Nva5;Glu11,26;Pra13]GpTx-1(1-34) | 2892 |
| DCLG[Nle]MRKCIED[Pra]DKCCRPNLVCSREHKWCKYVF-{Amide} | [Nle5;Glu11,26;Pra13]GpTx-1(1-34) | 2893 |
| DCLGVMRKCIED[Pra]DKCCRPNLVCSREHKWCKYVF-{Amide} | [Val5;Glu11,26;Pra13]GpTx-1(1-34) | 2894 |
| DCLGLMRKCIED[Pra]DKCCRPNLVCSREHKWCKYVF-{Amide} | [Leu5;Glu11,26;Pra13]GpTx-1(1-34) | 2895 |
| DCLGIMRKCIED[Pra]DKCCRPNLVCSREHKWCKYVF-{Amide} | [Ile5;Glu11,26;Pra13]GpTx-1(1-34) | 2896 |
| DCLGFFRKCEPD[Pra]DKCCRPNLVCSREHKWCKYVF-{Amide} | [Phe6;Glu10,26;Pra13]GpTx-1(1-34) | 2897 |
| DCLGFLRKCEPD[Pra]DKCCRPNLVCSREHKWCKYVF-{Amide} | [Leu6;Glu10,26;Pra13]GpTx-1(1-34) | 2898 |
| DCLGF[Nle]RKCEPD[Pra]DKCCRPNLVCSREHKWCKYVF-{Amide} | [Nle6;Glu10,26;Pra13]GpTx-1(1-34) | 2899 |
| DCLGGMRKCEPD[Pra]DKCCRPNLVCSREHKWCKYVF-{Amide} | [Gly5;Glu10,26;Pra13]GpTx-1(1-34) | 2900 |
| DCLGAMRKCEPD[Pra]DKCCRPNLVCSREHKWCKYVF-{Amide} | [Ala5;Glu10,26;Pra13]GpTx-1(1-34) | 2901 |
| DCLG[2-Abu]MRKCEPD[Pra]DKCCRPNLVCSREHKWCKYVF-{Amide} | [2-Abu5;Glu10,26;Pra13]GpTx-1(1-34) | 2902 |
| DCLG[Nva]MRKCEPD[Pra]DKCCRPNLVCSREHKWCKYVF-{Amide} | [Nva5;Glu10,26;Pra13]GpTx-1(1-34) | 2903 |
| DCLG[Nle]MRKCEPD[Pra]DKCCRPNLVCSREHKWCKYVF-{Amide} | [Nle5;Glu10,26;Pra13]GpTx-1(1-34) | 2904 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGVMRKCEPD[Pra]DKCCRPNLVCSREHKWCKYVF-{Amide} | [Val5;Glu10,26;Pra13]GpTx-1(1-34) | 2905 |
| DCLGLMRKCEPD[Pra]DKCCRPNLVCSREHKWCKYVF-{Amide} | [Leu5;Glu10,26;Pra13]GpTx-1(1-34) | 2906 |
| DCLGIMRKCEPD[Pra]DKCCRPNLVCSREHKWCKYVF-{Amide} | [Ile5;Glu10,26;Pra13]GpTx-1(1-34) | 2907 |
| DCLGFFRKCDPD[Pra]DKCCRPNLVCSREHKWCKYVF-{Amide} | [Phe6;Asp10;Pra13;Glu26]GpTx-1(1-34) | 2908 |
| DCLGFLRKCDPD[Pra]DKCCRPNLVCSREHKWCKYVF-{Amide} | [Leu6;Asp10;Pra13;Glu26]GpTx-1(1-34) | 2909 |
| DCLGF[Nle]RKCDPD[Pra]DKCCRPNLVCSREHKWCKYVF-{Amide} | [Nle6;Asp10;Pra13;Glu26]GpTx-1(1-34) | 2910 |
| DCLGGMRKCDPD[Pra]DKCCRPNLVCSREHKWCKYVF-{Amide} | [Gly5;Asp10;Pra13;Glu26]GpTx-1(1-34) | 2911 |
| DCLGAMRKCDPD[Pra]DKCCRPNLVCSREHKWCKYVF-{Amide} | [Ala5;Asp10;Pra13;Glu26]GpTx-1(1-34) | 2912 |
| DCLG[2-Abu]MRKCDPD[Pra]DKCCRPNLVCSREHKWCKYVF-{Amide} | [2-Abu5;Asp10;Pra13;Glu26]GpTx-1(1-34) | 2913 |
| DCLG[Nva]MRKCDPD[Pra]DKCCRPNLVCSREHKWCKYVF-{Amide} | [Nva5;Asp10;Pra13;Glu26]GpTx-1(1-34) | 2914 |
| DCLG[Nle]MRKCDPD[Pra]DKCCRPNLVCSREHKWCKYVF-{Amide} | [Nle5;Asp10;Pra13;Glu26]GpTx-1(1-34) | 2915 |
| DCLGVMRKCDPD[Pra]DKCCRPNLVCSREHKWCKYVF-{Amide} | [Val5;Asp10;Pra13;Glu26]GpTx-1(1-34) | 2916 |
| DCLGLMRKCDPD[Pra]DKCCRPNLVCSREHKWCKYVF-{Amide} | [Leu5;Asp10;Pra13;Glu26]GpTx-1(1-34) | 2917 |
| DCLGIMRKCDPD[Pra]DKCCRPNLVCSREHKWCKYVF-{Amide} | [Ile5;Asp10;Pra13;Glu26]GpTx-1(1-34) | 2918 |
| DCLGGFRKCIPD[Pra]DKCCRPNLVCSREHKWCKYVF-{Amide} | [Gly5;Phe6;Pra13;Glu26]GpTx-1(1-34) | 2919 |
| DCLGAFRKCIPD[Pra]DKCCRPNLVCSREHKWCKYVF-{Amide} | [Ala5;Phe6;Pra13;Glu26]GpTx-1(1-34) | 2920 |
| DCLG[2-Abu]FRKCIPD[Pra]DKCCRPNLVCSREHKWCKYVF-{Amide} | [2-Abu5;Phe6;Pra13;Glu26]GpTx-1(1-34) | 2921 |
| DCLG[Nva]FRKCIPD[Pra]DKCCRPNLVCSREHKWCKYVF-{Amide} | [Nva5;Phe6;Pra13;Glu26]GpTx-1(1-34) | 2922 |
| DCLG[Nle]FRKCIPD[Pra]DKCCRPNLVCSREHKWCKYVF-{Amide} | [Nle5;Phe6;Pra13;Glu26]GpTx-1(1-34) | 2923 |
| DCLGVFRKCIPD[Pra]DKCCRPNLVCSREHKWCKYVF-{Amide} | [Val5;Phe6;Pra13;Glu26]GpTx-1(1-34) | 2924 |
| DCLGLFRKCIPD[Pra]DKCCRPNLVCSREHKWCKYVF-{Amide} | [Leu5;Phe6;Pra13;Glu26]GpTx-1(1-34) | 2925 |
| DCLGIFRKCIPD[Pra]DKCCRPNLVCSREHKWCKYVF-{Amide} | [Ile5;Phe6;Pra13;Glu26]GpTx-1(1-34) | 2926 |
| DCLGGLRKCIPD[Pra]DKCCRPNLVCSREHKWCKYVF-{Amide} | [Gly5;Leu6;Pra13;Glu26]GpTx-1(1-34) | 2927 |
| DCLGALRKCIPD[Pra]DKCCRPNLVCSREHKWCKYVF-{Amide} | [Ala5;Leu6;Pra13;Glu26]GpTx-1(1-34) | 2928 |
| DCLG[2-Abu]LRKCIPD[Pra]DKCCRPNLVCSREHKWCKYVF-{Amide} | [2-Abu5;Leu6;Pra13;Glu26]GpTx-1(1-34) | 2929 |
| DCLG[Nva]LRKCIPD[Pra]DKCCRPNLVCSREHKWCKYVF-{Amide} | [Nva5;Leu6;Pra13;Glu26]GpTx-1(1-34) | 2930 |
| DCLG[Nle]LRKCIPD[Pra]DKCCRPNLVCSREHKWCKYVF-{Amide} | [Nle5;Leu6;Pra13;Glu26]GpTx-1(1-34) | 2931 |
| DCLGVLRKCIPD[Pra]DKCCRPNLVCSREHKWCKYVF-{Amide} | [Val5;Leu6;Pra13;Glu26]GpTx-1(1-34) | 2932 |
| DCLGLLRKCIPD[Pra]DKCCRPNLVCSREHKWCKYVF-{Amide} | [Leu5,6;Pra13;Glu26]GpTx-1(1-34) | 2933 |
| DCLGILRKCIPD[Pra]DKCCRPNLVCSREHKWCKYVF-{Amide} | [Ile5;Leu6;Pra13;Glu26]GpTx-1(1-34) | 2934 |
| DCLGG[Nle]RKCIPD[Pra]DKCCRPNLVCSREHKWCKYVF-{Amide} | [Gly5;Nle6;Pra13;Glu26]GpTx-1(1-34) | 2935 |
| DCLGA[Nle]RKCIPD[Pra]DKCCRPNLVCSREHKWCKYVF-{Amide} | [Ala5;Nle6;Pra13;Glu26]GpTx-1(1-34) | 2936 |
| DCLG[2-Abu][Nle]RKCIPD[Pra]DKCCRPNLVCSREHKWCKYVF-{Amide} | [2-Abu5;Nle6;Pra13;Glu26]GpTx-1(1-34) | 2937 |
| DCLG[Nva][Nle]RKCIPD[Pra]DKCCRPNLVCSREHKWCKYVF-{Amide} | [Nva5;Nle6;Pra13;Glu26]GpTx-1(1-34) | 2938 |
| DCLG[Nle][Nle]RKCIPD[Pra]DKCCRPNLVCSREHKWCKYVF-{Amide} | [Nle5,6;Pra13;Glu26]GpTx-1(1-34) | 2939 |
| DCLGV[Nle]RKCIPD[Pra]DKCCRPNLVCSREHKWCKYVF-{Amide} | [Val5;Nle6;Pra13;Glu26]GpTx-1(1-34) | 2940 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGL[Nle]RKCIPD[Pra]DKCCRPNLVCSREHKWCKYVF-{Amide} | [Leu5;Nle6;Pra13;Glu26]GpTx-1(1-34) | 2941 |
| DCLGI[Nle]RKCIPD[Pra]DKCCRPNLVCSREHKWCKYVF-{Amide} | [Ile5;Nle6;Pra13;Glu26]GpTx-1(1-34) | 2942 |
| DCLGGFRKCIED[2-Abu]DKCCRPNLVCSREHKWCKYVF-{Amide} | [Gly5;Phe6;Glu11,26;2-Abu13]GpTx-1(1-34) | 2943 |
| DCLGAFRKCIED[2-Abu]DKCCRPNLVCSREHKWCKYVF-{Amide} | [Ala5;Phe6;Glu11,26;2-Abu13]GpTx-1(1-34) | 2944 |
| DCLG[2-Abu]FRKCIED[2-Abu]DKCCRPNLVCSREHKWCKYVF-{Amide} | [2-Abu5,13;Phe6;Glu11,26]GpTx-1(1-34) | 2945 |
| DCLG[Nva]FRKCIED[2-Abu]DKCCRPNLVCSREHKWCKYVF-{Amide} | [Nva5;Phe6;Glu11,26;2-Abu13]GpTx-1(1-34) | 2946 |
| DCLG[Nle]FRKCIED[2-Abu]DKCCRPNLVCSREHKWCKYVF-{Amide} | [Nle5;Phe6;Glu11,26;2-Abu13]GpTx-1(1-34) | 2947 |
| DCLGVFRKCIED[2-Abu]DKCCRPNLVCSREHKWCKYVF-{Amide} | [Val5;Phe6;Glu11,26;2-Abu13]GpTx-1(1-34) | 2948 |
| DCLGLFRKCIED[2-Abu]DKCCRPNLVCSREHKWCKYVF-{Amide} | [Leu5;Phe6;Glu11,26;2-Abu13]GpTx-1(1-34) | 2949 |
| DCLGIFRKCIED[2-Abu]DKCCRPNLVCSREHKWCKYVF-{Amide} | [Ile5;Phe6;Glu11,26;2-Abu13]GpTx-1(1-34) | 2950 |
| DCLGGLRKCIED[2-Abu]DKCCRPNLVCSREHKWCKYVF-{Amide} | [Gly5;Leu6;Glu11,26;2-Abu13]GpTx-1(1-34) | 2951 |
| DCLGALRKCIED[2-Abu]DKCCRPNLVCSREHKWCKYVF-{Amide} | [Ala5;Leu6;Glu11,26;2-Abu13]GpTx-1(1-34) | 2952 |
| DCLG[2-Abu]LRKCIED[2-Abu]DKCCRPNLVCSREHKWCKYVF-{Amide} | [2-Abu5,13;Leu6;Glu11,26]GpTx-1(1-34) | 2953 |
| DCLG[Nva]LRKCIED[2-Abu]DKCCRPNLVCSREHKWCKYVF-{Amide} | [Nva5;Leu6;Glu11,26;2-Abu13]GpTx-1(1-34) | 2954 |
| DCLG[Nle]LRKCIED[2-Abu]DKCCRPNLVCSREHKWCKYVF-{Amide} | [Nle5;Leu6;Glu11,26;2-Abu13]GpTx-1(1-34) | 2955 |
| DCLGVLRKCIED[2-Abu]DKCCRPNLVCSREHKWCKYVF-{Amide} | [Val5;Leu6;Glu11,26;2-Abu13]GpTx-1(1-34) | 2956 |
| DCLGLLRKCIED[2-Abu]DKCCRPNLVCSREHKWCKYVF-{Amide} | [Leu5,6;Glu11,26;2-Abu13]GpTx-1(1-34) | 2957 |
| DCLGILRKCIED[2-Abu]DKCCRPNLVCSREHKWCKYVF-{Amide} | [Ile5;Leu6;Glu11,26;2-Abu13]GpTx-1(1-34) | 2958 |
| DCLGG[Nle]RKCIED[2-Abu]DKCCRPNLVCSREHKWCKYVF-{Amide} | [Gly5;Nle6;Glu11,26;2-Abu13]GpTx-1(1-34) | 2959 |
| DCLGA[Nle]RKCIED[2-Abu]DKCCRPNLVCSREHKWCKYVF-{Amide} | [Ala5;Nle6;Glu11,26;2-Abu13]GpTx-1(1-34) | 2960 |
| DCLG[2-Abu][Nle]RKCIED[2-Abu]DKCCRPNLVCSREHKWCKYVF-{Amide} | [2-Abu5,13;Nle6;Glu11,26]GpTx-1(1-34) | 2961 |
| DCLG[Nva][Nle]RKCIED[2-Abu]DKCCRPNLVCSREHKWCKYVF-{Amide} | [Nva5;Nle6;Glu11,26;2-Abu13]GpTx-1(1-34) | 2962 |
| DCLG[Nle][Nle]RKCIED[2-Abu]DKCCRPNLVCSREHKWCKYVF-{Amide} | [Nle5,6;Glu11,26;2-Abu13]GpTx-1(1-34) | 2963 |
| DCLGV[Nle]RKCIED[2-Abu]DKCCRPNLVCSREHKWCKYVF-{Amide} | [Val5;Nle6;Glu11,26;2-Abu13]GpTx-1(1-34) | 2964 |
| DCLGL[Nle]RKCIED[2-Abu]DKCCRPNLVCSREHKWCKYVF-{Amide} | [Leu5;Nle6;Glu11,26;2-Abu13]GpTx-1(1-34) | 2965 |
| DCLGI[Nle]RKCIED[2-Abu]DKCCRPNLVCSREHKWCKYVF-{Amide} | [Ile5;Nle6;Glu11,26;2-Abu13]GpTx-1(1-34) | 2966 |
| DCLGGFRKCEPD[2-Abu]DKCCRPNLVCSREHKWCKYVF-{Amide} | [Gly5;Phe6;Glu10,26;2-Abu13]GpTx-1(1-34) | 2967 |
| DCLGAFRKCEPD[2-Abu]DKCCRPNLVCSREHKWCKYVF-{Amide} | [Ala5;Phe6;Glu10,26;2-Abu13]GpTx-1(1-34) | 2968 |
| DCLG[2-Abu]FRKCEPD[2-Abu]DKCCRPNLVCSREHKWCKYVF-{Amide} | [2-Abu5,13;Phe6;Glu10,26]GpTx-1(1-34) | 2969 |
| DCLG[Nva]FRKCEPD[2-Abu]DKCCRPNLVCSREHKWCKYVF-{Amide} | [Nva5;Phe6;Glu10,26;2-Abu13]GpTx-1(1-34) | 2970 |
| DCLG[Nle]FRKCEPD[2-Abu]DKCCRPNLVCSREHKWCKYVF-{Amide} | [Nle5;Phe6;Glu10,26;2-Abu13]GpTx-1(1-34) | 2971 |
| DCLGVFRKCEPD[2-Abu]DKCCRPNLVCSREHKWCKYVF-{Amide} | [Val5;Phe6;Glu10,26;2-Abu13]GpTx-1(1-34) | 2972 |
| DCLGLFRKCEPD[2-Abu]DKCCRPNLVCSREHKWCKYVF-{Amide} | [Leu5;Phe6;Glu10,26;2-Abu13]GpTx-1(1-34) | 2973 |
| DCLGIFRKCEPD[2-Abu]DKCCRPNLVCSREHKWCKYVF-{Amide} | [Ile5;Phe6;Glu10,26;2-Abu13]GpTx-1(1-34) | 2974 |
| DCLGGLRKCEPD[2-Abu]DKCCRPNLVCSREHKWCKYVF-{Amide} | [Gly5;Leu6;Glu10,26;2-Abu13]GpTx-1(1-34) | 2975 |
| DCLGALRKCEPD[2-Abu]DKCCRPNLVCSREHKWCKYVF-{Amide} | [Ala5;Leu6;Glu10,26;2-Abu13]GpTx-1(1-34) | 2976 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[2-Abu]LRKCEPD[2-Abu]DKCCRPNLVCSREHKWCKYVF-{Amide} | [2-Abu5,13;Leu6;Glu10,26]GpTx-1(1-34) | 2977 |
| DCLG[Nva]LRKCEPD[2-Abu]DKCCRPNLVCSREHKWCKYVF-{Amide} | [Nva5;Leu6;Glu10,26;2-Abu13]GpTx-1(1-34) | 2978 |
| DCLG[Nle]LRKCEPD[2-Abu]DKCCRPNLVCSREHKWCKYVF-{Amide} | [Nle5;Leu6;Glu10,26;2-Abu13]GpTx-1(1-34) | 2979 |
| DCLGVLRKCEPD[2-Abu]DKCCRPNLVCSREHKWCKYVF-{Amide} | [Val5;Leu6;Glu10,26;2-Abu13]GpTx-1(1-34) | 2980 |
| DCLGLLRKCEPD[2-Abu]DKCCRPNLVCSREHKWCKYVF-{Amide} | [Leu5,6;Glu10,26;2-Abu13]GpTx-1(1-34) | 2981 |
| DCLGILRKCEPD[2-Abu]DKCCRPNLVCSREHKWCKYVF-{Amide} | [Ile5;Leu6;Glu10,26;2-Abu13]GpTx-1(1-34) | 2982 |
| DCLGG[Nle]RKCEPD[2-Abu]DKCCRPNLVCSREHKWCKYVF-{Amide} | [Gly5;Nle6;Glu10,26;2-Abu13]GpTx-1(1-34) | 2983 |
| DCLGA[Nle]RKCEPD[2-Abu]DKCCRPNLVCSREHKWCKYVF-{Amide} | [Ala5;Nle6;Glu10,26;2-Abu13]GpTx-1(1-34) | 2984 |
| DCLG[2-Abu][Nle]RKCEPD[2-Abu]DKCCRPNLVCSREHKWCKYVF-{Amide} | [2-Abu5,13;Nle6;Glu10,26]GpTx-1(1-34) | 2985 |
| DCLG[Nva][Nle]RKCEPD[2-Abu]DKCCRPNLVCSREHKWCKYVF-{Amide} | [Nva5;Nle6;Glu10,26;2-Abu13]GpTx-1(1-34) | 2986 |
| DCLG[Nle][Nle]RKCEPD[2-Abu]DKCCRPNLVCSREHKWCKYVF-{Amide} | [Nle5,6;Glu10,26;2-Abu13]GpTx-1(1-34) | 2987 |
| DCLGV[Nle]RKCEPD[2-Abu]DKCCRPNLVCSREHKWCKYVF-{Amide} | [Val5;Nle6;Glu10,26;2-Abu13]GpTx-1(1-34) | 2988 |
| DCLGL[Nle]RKCEPD[2-Abu]DKCCRPNLVCSREHKWCKYVF-{Amide} | [Leu5;Nle6;Glu10,26;2-Abu13]GpTx-1(1-34) | 2989 |
| DCLGI[Nle]RKCEPD[2-Abu]DKCCRPNLVCSREHKWCKYVF-{Amide} | [Ile5;Nle6;Glu10,26;2-Abu13]GpTx-1(1-34) | 2990 |
| DCLGGFRKCDPD[2-Abu]DKCCRPNLVCSREHKWCKYVF-{Amide} | [Gly5;Phe6;Asp10;2-Abu13;Glu26]GpTx-1(1-34) | 2991 |
| DCLGAFRKCDPD[2-Abu]DKCCRPNLVCSREHKWCKYVF-{Amide} | [Ala5;Phe6;Asp10;2-Abu13;Glu26]GpTx-1(1-34) | 2992 |
| DCLG[2-Abu]FRKCDPD[2-Abu]DKCCRPNLVCSREHKWCKYVF-{Amide} | [2-Abu5,13;Phe6;Asp10;Glu26]GpTx-1(1-34) | 2993 |
| DCLG[Nva]FRKCDPD[2-Abu]DKCCRPNLVCSREHKWCKYVF-{Amide} | [Nva5;Phe6;Asp10;2-Abu13;Glu26]GpTx-1(1-34) | 2994 |
| DCLG[Nle]FRKCDPD[2-Abu]DKCCRPNLVCSREHKWCKYVF-{Amide} | [Nle5;Phe6;Asp10;2-Abu13;Glu26]GpTx-1(1-34) | 2995 |
| DCLGVFRKCDPD[2-Abu]DKCCRPNLVCSREHKWCKYVF-{Amide} | [Val5;Phe6;Asp10;2-Abu13;Glu26]GpTx-1(1-34) | 2996 |
| DCLGLFRKCDPD[2-Abu]DKCCRPNLVCSREHKWCKYVF-{Amide} | [Leu5;Phe6;Asp10;2-Abu13;Glu26]GpTx-1(1-34) | 2997 |
| DCLGIFRKCDPD[2-Abu]DKCCRPNLVCSREHKWCKYVF-{Amide} | [Ile5;Phe6;Asp10;2-Abu13;Glu26]GpTx-1(1-34) | 2998 |
| DCLGGLRKCDPD[2-Abu]DKCCRPNLVCSREHKWCKYVF-{Amide} | [Gly5;Leu6;Asp10;2-Abu13;Glu26]GpTx-1(1-34) | 2999 |
| DCLGALRKCDPD[2-Abu]DKCCRPNLVCSREHKWCKYVF-{Amide} | [Ala5;Leu6;Asp10;2-Abu13;Glu26]GpTx-1(1-34) | 3000 |
| DCLG[2-Abu]LRKCDPD[2-Abu]DKCCRPNLVCSREHKWCKYVF-{Amide} | [2-Abu5,13;Leu6;Asp10;Glu26]GpTx-1(1-34) | 3001 |
| DCLG[Nva]LRKCDPD[2-Abu]DKCCRPNLVCSREHKWCKYVF-{Amide} | [Nva5;Leu6;Asp10;2-Abu13;Glu26]GpTx-1(1-34) | 3002 |
| DCLG[Nle]LRKCDPD[2-Abu]DKCCRPNLVCSREHKWCKYVF-{Amide} | [Nle5;Leu6;Asp10;2-Abu13;Glu26]GpTx-1(1-34) | 3003 |
| DCLGVLRKCDPD[2-Abu]DKCCRPNLVCSREHKWCKYVF-{Amide} | [Val5;Leu6;Asp10;2-Abu13;Glu26]GpTx-1(1-34) | 3004 |
| DCLGLLRKCDPD[2-Abu]DKCCRPNLVCSREHKWCKYVF-{Amide} | [Leu5,6;Asp10;2-Abu13;Glu26]GpTx-1(1-34) | 3005 |
| DCLGILRKCDPD[2-Abu]DKCCRPNLVCSREHKWCKYVF-{Amide} | [Ile5;Leu6;Asp10;2-Abu13;Glu26]GpTx-1(1-34) | 3006 |
| DCLGG[Nle]RKCDPD[2-Abu]DKCCRPNLVCSREHKWCKYVF-{Amide} | [Gly5;Nle6;Asp10;2-Abu13;Glu26]GpTx-1(1-34) | 3007 |
| DCLGA[Nle]RKCDPD[2-Abu]DKCCRPNLVCSREHKWCKYVF-{Amide} | [Ala5;Nle6;Asp10;2-Abu13;Glu26]GpTx-1(1-34) | 3008 |
| DCLG[2-Abu][Nle]RKCDPD[2-Abu]DKCCRPNLVCSREHKWCKYVF-{Amide} | [2-Abu5,13;Nle6;Asp10;Glu26]GpTx-1(1-34) | 3009 |
| DCLG[Nva][Nle]RKCDPD[2-Abu]DKCCRPNLVCSREHKWCKYVF-{Amide} | [Nva5;Nle6;Asp10;2-Abu13;Glu26]GpTx-1(1-34) | 3010 |

TABLE 5B-continued

| Amino acid sequences of GpTx-1 and GpTx-1 peptide analogs. -{Amide} = amidated C-terminal. | | |
|---|---|---|
| Amino Acid Sequence | Designation | SEQ ID NO. |
| DCLG[Nle][Nle]RKCDPD[2-Abu]DKCCRPNLVCSREHKWCKYVF-{Amide} | [Nle5,6;Asp10;2-Abu13;Glu26]GpTx-1(1-34) | 3011 |
| DCLGV[Nle]RKCDPD[2-Abu]DKCCRPNLVCSREHKWCKYVF-{Amide} | [Val5;Nle6;Asp10;2-Abu13;Glu26]GpTx-1(1-34) | 3012 |
| DCLGL[Nle]RKCDPD[2-Abu]DKCCRPNLVCSREHKWCKYVF-{Amide} | [Leu5;Nle6;Asp10;2-Abu13;Glu26]GpTx-1(1-34) | 3013 |
| DCLGI[Nle]RKCDPD[2-Abu]DKCCRPNLVCSREHKWCKYVF-{Amide} | [Ile5;Nle6;Asp10;2-Abu13;Glu26]GpTx-1(1-34) | 3014 |
| DCLGGFRKCIED[Pra]DKCCRPNLVCSREHKWCKYVF-{Amide} | [Gly5;Phe6;Glu11,26;Pra13]GpTx-1(1-34) | 3015 |
| DCLGAFRKCIED[Pra]DKCCRPNLVCSREHKWCKYVF-{Amide} | [Ala5;Phe6;Glu11,26;Pra13]GpTx-1(1-34) | 3016 |
| DCLG[2-Abu]FRKCIED[Pra]DKCCRPNLVCSREHKWCKYVF-{Amide} | [2-Abu5;Phe6;Glu11,26;Pra13]GpTx-1(1-34) | 3017 |
| DCLG[Nva]FRKCIED[Pra]DKCCRPNLVCSREHKWCKYVF-{Amide} | [Nva5;Phe6;Glu11,26;Pra13]GpTx-1(1-34) | 3018 |
| DCLG[Nle]FRKCIED[Pra]DKCCRPNLVCSREHKWCKYVF-{Amide} | [Nle5;Phe6;Glu11,26;Pra13]GpTx-1(1-34) | 3019 |
| DCLGVFRKCIED[Pra]DKCCRPNLVCSREHKWCKYVF-{Amide} | [Val5;Phe6;Glu11,26;Pra13]GpTx-1(1-34) | 3020 |
| DCLGLFRKCIED[Pra]DKCCRPNLVCSREHKWCKYVF-{Amide} | [Leu5;Phe6;Glu11,26;Pra13]GpTx-1(1-34) | 3021 |
| DCLGIFRKCIED[Pra]DKCCRPNLVCSREHKWCKYVF-{Amide} | [Ile5;Phe6;Glu11,26;Pra13]GpTx-1(1-34) | 3022 |
| DCLGGLRKCIED[Pra]DKCCRPNLVCSREHKWCKYVF-{Amide} | [Gly5;Leu6;Glu11,26;Pra13]GpTx-1(1-34) | 3023 |
| DCLGALRKCIED[Pra]DKCCRPNLVCSREHKWCKYVF-{Amide} | [Ala5;Leu6;Glu11,26;Pra13]GpTx-1(1-34) | 3024 |
| DCLG[2-Abu]LRKCIED[Pra]DKCCRPNLVCSREHKWCKYVF-{Amide} | [2-Abu5;Leu6;Glu11,26;Pra13]GpTx-1(1-34) | 3025 |
| DCLG[Nva]LRKCIED[Pra]DKCCRPNLVCSREHKWCKYVF-{Amide} | [Nva5;Leu6;Glu11,26;Pra13]GpTx-1(1-34) | 3026 |
| DCLG[Nle]LRKCIED[Pra]DKCCRPNLVCSREHKWCKYVF-{Amide} | [Nle5;Leu6;Glu11,26;Pra13]GpTx-1(1-34) | 3027 |
| DCLGVLRKCIED[Pra]DKCCRPNLVCSREHKWCKYVF-{Amide} | [Val5;Leu6;Glu11,26;Pra13]GpTx-1(1-34) | 3028 |
| DCLGLLRKCIED[Pra]DKCCRPNLVCSREHKWCKYVF-{Amide} | [Leu5,6;Glu11,26;Pra13]GpTx-1(1-34) | 3029 |
| DCLGILRKCIED[Pra]DKCCRPNLVCSREHKWCKYVF-{Amide} | [Ile5;Leu6;Glu11,26;Pra13]GpTx-1(1-34) | 3030 |
| DCLGG[Nle]RKCIED[Pra]DKCCRPNLVCSREHKWCKYVF-{Amide} | [Gly5;Nle6;Glu11,26;Pra13]GpTx-1(1-34) | 3031 |
| DCLGA[Nle]RKCIED[Pra]DKCCRPNLVCSREHKWCKYVF-{Amide} | [Ala5;Nle6;Glu11,26;Pra13]GpTx-1(1-34) | 3032 |
| DCLG[2-Abu][Nle]RKCIED[Pra]DKCCRPNLVCSREHKWCKYVF-{Amide} | [2-Abu5;Nle6;Glu11,26;Pra13]GpTx-1(1-34) | 3033 |
| DCLG[Nva][Nle]RKCIED[Pra]DKCCRPNLVCSREHKWCKYVF-{Amide} | [Nva5;Nle6;Glu11,26;Pra13]GpTx-1(1-34) | 3034 |
| DCLG[Nle][Nle]RKCIED[Pra]DKCCRPNLVCSREHKWCKYVF-{Amide} | [Nle5,6;Glu11,26;Pra13]GpTx-1(1-34) | 3035 |
| DCLGV[Nle]RKCIED[Pra]DKCCRPNLVCSREHKWCKYVF-{Amide} | [Val5;Nle6;Glu11,26;Pra13]GpTx-1(1-34) | 3036 |
| DCLGL[Nle]RKCIED[Pra]DKCCRPNLVCSREHKWCKYVF-{Amide} | [Leu5;Nle6;Glu11,26;Pra13]GpTx-1(1-34) | 3037 |
| DCLGI[Nle]RKCIED[Pra]DKCCRPNLVCSREHKWCKYVF-{Amide} | [Ile5;Nle6;Glu11,26;Pra13]GpTx-1(1-34) | 3038 |
| DCLGGFRKCEPD[Pra]DKCCRPNLVCSREHKWCKYVF-{Amide} | [Gly5;Phe6;Glu10,26;Pra13]GpTx-1(1-34) | 3039 |
| DCLGAFRKCEPD[Pra]DKCCRPNLVCSREHKWCKYVF-{Amide} | [Ala5;Phe6;Glu10,26;Pra13]GpTx-1(1-34) | 3040 |
| DCLG[2-Abu]FRKCEPD[Pra]DKCCRPNLVCSREHKWCKYVF-{Amide} | [2-Abu5;Phe6;Glu10,26;Pra13]GpTx-1(1-34) | 3041 |
| DCLG[Nva]FRKCEPD[Pra]DKCCRPNLVCSREHKWCKYVF-{Amide} | [Nva5;Phe6;Glu10,26;Pra13]GpTx-1(1-34) | 3042 |
| DCLG[Nle]FRKCEPD[Pra]DKCCRPNLVCSREHKWCKYVF-{Amide} | [Nle5;Phe6;Glu10,26;Pra13]GpTx-1(1-34) | 3043 |
| DCLGVFRKCEPD[Pra]DKCCRPNLVCSREHKWCKYVF-{Amide} | [Val5;Phe6;Glu10,26;Pra13]GpTx-1(1-34) | 3044 |
| DCLGLFRKCEPD[Pra]DKCCRPNLVCSREHKWCKYVF-{Amide} | [Leu5;Phe6;Glu10,26;Pra13]GpTx-1(1-34) | 3045 |
| DCLGIFRKCEPD[Pra]DKCCRPNLVCSREHKWCKYVF-{Amide} | [Ile5;Phe6;Glu10,26;Pra13]GpTx-1(1-34) | 3046 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLGGLRKCEPD[Pra]DKCCRPNLVCSREHKWCKYVF-{Amide} | [Gly5;Leu6;Glu10,26;Pra13]GpTx-1(1-34) | 3047 |
| DCLGALRKCEPD[Pra]DKCCRPNLVCSREHKWCKYVF-{Amide} | [Ala5;Leu6;Glu10,26;Pra13]GpTx-1(1-34) | 3048 |
| DCLG[2-Abu]LRKCEPD[Pra]DKCCRPNLVCSREHKWCKYVF-{Amide} | [2-Abu5;Leu6;Glu10,26;Pra13]GpTx-1(1-34) | 3049 |
| DCLG[Nva]LRKCEPD[Pra]DKCCRPNLVCSREHKWCKYVF-{Amide} | [Nva5;Leu6;Glu10,26;Pra13]GpTx-1(1-34) | 3050 |
| DCLG[Nle]LRKCEPD[Pra]DKCCRPNLVCSREHKWCKYVF-{Amide} | [Nle5;Leu6;Glu10,26;Pra13]GpTx-1(1-34) | 3051 |
| DCLGVLRKCEPD[Pra]DKCCRPNLVCSREHKWCKYVF-{Amide} | [Val5;Leu6;Glu10,26;Pra13]GpTx-1(1-34) | 3052 |
| DCLGLLRKCEPD[Pra]DKCCRPNLVCSREHKWCKYVF-{Amide} | [Leu5,6;Glu10,26;Pra13]GpTx-1(1-34) | 3053 |
| DCLGILRKCEPD[Pra]DKCCRPNLVCSREHKWCKYVF-{Amide} | [Ile5;Leu6;Glu10,26;Pra13]GpTx-1(1-34) | 3054 |
| DCLGG[Nle]RKCEPD[Pra]DKCCRPNLVCSREHKWCKYVF-{Amide} | [Gly5;Nle6;Glu10,26;Pra13]GpTx-1(1-34) | 3055 |
| DCLGA[Nle]RKCEPD[Pra]DKCCRPNLVCSREHKWCKYVF-{Amide} | [Ala5;Nle6;Glu10,26;Pra13]GpTx-1(1-34) | 3056 |
| DCLG[2-Abu][Nle]RKCEPD[Pra]DKCCRPNLVCSREHKWCKYVF-{Amide} | [2-Abu5;Nle6;Glu10,26;Pra13]GpTx-1(1-34) | 3057 |
| DCLG[Nva][Nle]RKCEPD[Pra]DKCCRPNLVCSREHKWCKYVF-{Amide} | [Nva5;Nle6;Glu10,26;Pra13]GpTx-1(1-34) | 3058 |
| DCLG[Nle][Nle]RKCEPD[Pra]DKCCRPNLVCSREHKWCKYVF-{Amide} | [Nle5,6;Glu10,26;Pra13]GpTx-1(1-34) | 3059 |
| DCLGV[Nle]RKCEPD[Pra]DKCCRPNLVCSREHKWCKYVF-{Amide} | [Val5;Nle6;Glu10,26;Pra13]GpTx-1(1-34) | 3060 |
| DCLGL[Nle]RKCEPD[Pra]DKCCRPNLVCSREHKWCKYVF-{Amide} | [Leu5;Nle6;Glu10,26;Pra13]GpTx-1(1-34) | 3061 |
| DCLGI[Nle]RKCEPD[Pra]DKCCRPNLVCSREHKWCKYVF-{Amide} | [Ile5;Nle6;Glu10,26;Pra13]GpTx-1(1-34) | 3062 |
| DCLGGFRKCDPD[Pra]DKCCRPNLVCSREHKWCKYVF-{Amide} | [Gly5;Phe6;Asp10;Pra13;Glu26]GpTx-1(1-34) | 3063 |
| DCLGAFRKCDPD[Pra]DKCCRPNLVCSREHKWCKYVF-{Amide} | [Ala5;Phe6;Asp10;Pra13;Glu26]GpTx-1(1-34) | 3064 |
| DCLG[2-Abu]FRKCDPD[Pra]DKCCRPNLVCSREHKWCKYVF-{Amide} | [2-Abu5;Phe6;Asp10;Pra13;Glu26]GpTx-1(1-34) | 3065 |
| DCLG[Nva]FRKCDPD[Pra]DKCCRPNLVCSREHKWCKYVF-{Amide} | [Nva5;Phe6;Asp10;Pra13;Glu26]GpTx-1(1-34) | 3066 |
| DCLG[Nle]FRKCDPD[Pra]DKCCRPNLVCSREHKWCKYVF-{Amide} | [Nle5;Phe6;Asp10;Pra13;Glu26]GpTx-1(1-34) | 3067 |
| DCLGVFRKCDPD[Pra]DKCCRPNLVCSREHKWCKYVF-{Amide} | [Val5;Phe6;Asp10;Pra13;Glu26]GpTx-1(1-34) | 3068 |
| DCLGLFRKCDPD[Pra]DKCCRPNLVCSREHKWCKYVF-{Amide} | [Leu5;Phe6;Asp10;Pra13;Glu26]GpTx-1(1-34) | 3069 |
| DCLGIFRKCDPD[Pra]DKCCRPNLVCSREHKWCKYVF-{Amide} | [Ile5;Phe6;Asp10;Pra13;Glu26]GpTx-1(1-34) | 3070 |
| DCLGGLRKCDPD[Pra]DKCCRPNLVCSREHKWCKYVF-{Amide} | [Gly5;Leu6;Asp10;Pra13;Glu26]GpTx-1(1-34) | 3071 |
| DCLGALRKCDPD[Pra]DKCCRPNLVCSREHKWCKYVF-{Amide} | [Ala5;Leu6;Asp10;Pra13;Glu26]GpTx-1(1-34) | 3072 |
| DCLG[2-Abu]LRKCDPD[Pra]DKCCRPNLVCSREHKWCKYVF-{Amide} | [2-Abu5;Leu6;Asp10;Pra13;Glu26]GpTx-1(1-34) | 3073 |
| DCLG[Nva]LRKCDPD[Pra]DKCCRPNLVCSREHKWCKYVF-{Amide} | [Nva5;Leu6;Asp10;Pra13;Glu26]GpTx-1(1-34) | 3074 |
| DCLG[Nle]LRKCDPD[Pra]DKCCRPNLVCSREHKWCKYVF-{Amide} | [Nle5;Leu6;Asp10;Pra13;Glu26]GpTx-1(1-34) | 3075 |
| DCLGVLRKCDPD[Pra]DKCCRPNLVCSREHKWCKYVF-{Amide} | [Val5;Leu6;Asp10;Pra13;Glu26]GpTx-1(1-34) | 3076 |
| DCLGLLRKCDPD[Pra]DKCCRPNLVCSREHKWCKYVF-{Amide} | [Leu5,6;Asp10;Pra13;Glu26]GpTx-1(1-34) | 3077 |
| DCLGILRKCDPD[Pra]DKCCRPNLVCSREHKWCKYVF-{Amide} | [Ile5;Leu6;Asp10;Pra13;Glu26]GpTx-1(1-34) | 3078 |
| DCLGG[Nle]RKCDPD[Pra]DKCCRPNLVCSREHKWCKYVF-{Amide} | [Gly5;Nle6;Asp10;Pra13;Glu26]GpTx-1(1-34) | 3079 |
| DCLGA[Nle]RKCDPD[Pra]DKCCRPNLVCSREHKWCKYVF-{Amide} | [Ala5;Nle6;Asp10;Pra13;Glu26]GpTx-1(1-34) | 3080 |
| DCLG[2-Abu][Nle]RKCDPD[Pra]DKCCRPNLVCSREHKWCKYVF-{Amide} | [2-Abu5;Nle6;Asp10;Pra13;Glu26]GpTx-1(1-34) | 3081 |
| DCLG[Nva][Nle]RKCDPD[Pra]DKCCRPNLVCSREHKWCKYVF-{Amide} | [Nva5;Nle6;Asp10;Pra13;Glu26]GpTx-1(1-34) | 3082 |

TABLE 5B-continued

Amino acid sequences of GpTx-1 and GpTx-1 peptide analogs. -{Amide} = amidated C-terminal.

| Amino Acid Sequence | Designation | SEQ ID NO. |
|---|---|---|
| DCLG[Nle][Nle]RKCDPD[Pra]DKCCRPNLVCSREHKWCKYVF-{Amide} | [Nle5,6;Asp10;Pra13;Glu26]GpTx-1(1-34) | 3083 |
| DCLGV[Nle]RKCDPD[Pra]DKCCRPNLVCSREHKWCKYVF-{Amide} | [Val5;Nle6;Asp10;Pra13;Glu26]GpTx-1(1-34) | 3084 |
| DCLGL[Nle]RKCDPD[Pra]DKCCRPNLVCSREHKWCKYVF-{Amide} | [Leu5;Nle6;Asp10;Pra13;Glu26]GpTx-1(1-34) | 3085 |
| DCLGI[Nle]RKCDPD[Pra]DKCCRPNLVCSREHKWCKYVF-{Amide} | [Ile5;Nle6;Asp10;Pra13;Glu26]GpTx-1(1-34) | 3086 |

As stated herein above, in accordance with the present invention, the peptide portions of the inventive composition of matter can also be chemically derivatized at one or more amino acid residues by known organic chemistry techniques. "Chemical derivative" or "chemically derivatized" refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine maybe substituted for lysine; 3-methylhistidine may be substituted for histidine; homoserine may be substituted for serine; and ornithine may be substituted for lysine.

Useful derivatizations include, in some embodiments, those in which the amino terminal of the peptide is chemically blocked so that conjugation with the vehicle will be prevented from taking place at an N-terminal free amino group. There may also be other beneficial effects of such a modification, for example a reduction in the toxin peptide analog's susceptibility to enzymatic proteolysis. The N-terminus can be acylated or modified to a substituted amine, or derivatized with another functional group, such as an aromatic moiety (e.g., an indole acid, benzyl (Bzl or Bn), dibenzyl (DiBzl or $Bn_2$), or benzyloxycarbonyl (Cbz or Z)), N,N-dimethylglycine or creatine. For example, in some embodiments, an acyl moiety, such as, but not limited to, a formyl, acetyl (Ac), propanoyl, butanyl, heptanyl, hexanoyl, octanoyl, or nonanoyl, can be covalently linked to the N-terminal end of the peptide, which can prevent undesired side reactions during conjugation of the vehicle to the peptide. Other exemplary N-terminal derivative groups include —$NRR^1$ (other than —$NH_2$), —$NRC(O)R^1$, —$NRC(O)OR^1$, —$NRS(O)_2R^1$, —NHC(O)$NHR^1$, succinimide, or benzyloxycarbonyl-NH—(Cbz-NH—), wherein R and $R^1$ are each independently hydrogen or lower alkyl and wherein the phenyl ring may be substituted with 1 to 3 substituents selected from $C_1$-$C_4$ alkyl, $C_1$-$C_4$ alkoxy, chloro, and bromo.

In some embodiments, one or more peptidyl [—C(O)NR-] linkages (bonds) between amino acid residues can be replaced by a non-peptidyl linkage. Exemplary non-peptidyl linkages are —$CH_2$-carbamate [—$CH_2$—OC(O)NR—], phosphonate, —$CH_2$-sulfonamide [—$CH_2$—$S(O)_2NR$—], urea [—NHC(O)NH—], —$CH_2$-secondary amine, and alkylated peptide [—$C(O)NR^6$— wherein $R^6$ is lower alkyl].

In some embodiments, one or more individual amino acid residues can be derivatized. Various derivatizing agents are known to react specifically with selected sidechains or terminal residues, as described in detail below by way of example.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N═C═N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking (See, e.g., Bhatnagar et al., J. Med. Chem., 39:3814-3819 (1996)).

Derivatization with bifunctional agents is useful for cross-linking the peptides or their functional derivatives to a water-insoluble support matrix, if desired, or to other macromolecular vehicles. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates, e.g., as described in U.S. Pat. Nos. 3,969,287; 3,691,016; 4,195,128; 4,247,642; 4,229,537; and 4,330,440, are employed for protein immobilization.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties (W. H. Freeman & Co., San Francisco), 79-86 (1983).

The above examples of derivatizations are not intended to be an exhaustive treatment, but merely illustrative.

The production of the composition of matter can also involve suitable protein purification techniques, when applicable. In some embodiments of the composition of matter of the invention, the molecule can be prepared to include a suitable isotopic label (e.g., $^{125}I$, $^{14}C$, $^{13}C$, $^{35}S$, $^{3}H$, $^{2}H$, $^{13}N$, $^{15}N$, $^{18}O$, $^{17}O$, etc.), for ease of quantification or detection.

Half-Life Extending Moieties.

Optionally, for modulation of the pharmacokinetic profile of the molecule to fit the therapeutic need, the composition of the present invention can include one or more half-life extending moieties of various masses and configurations, which half-life extending moiety, or moieties, can be covalently fused, attached, linked or conjugated to the toxin peptide analog. A "half-life extending moiety" refers to a molecule that prevents or mitigates in vivo degradation by proteolysis or other activity-diminishing chemical modification, increases in vivo half-life or other pharmacokinetic properties such as but not limited to increasing the rate of absorption, reduces toxicity, reduces immunogenicity, improves solubility, increases biological activity and/or target selectivity of the toxin peptide analog with respect to a target of interest, and/or increases manufacturability, compared to an unconjugated form of the toxin peptide analog. In accordance with the invention, the half-life extending moiety is one that is pharmaceutically acceptable.

The half-life extending moiety can be selected such that the inventive composition achieves a sufficient hydrodynamic size to prevent clearance by renal filtration in vivo. For example, a half-life extending moiety can be selected that is a polymeric macromolecule, which is substantially straight chain, branched-chain (br), or dendritic in form. Alternatively, a half-life extending moiety can be selected such that, in vivo, the inventive composition of matter will bind to a serum protein to form a complex, such that the complex thus formed avoids substantial renal clearance. The half-life extending moiety can be, for example, a lipid; a cholesterol group (such as a steroid); a carbohydrate or oligosaccharide; or any natural or synthetic protein, polypeptide or peptide that binds to a salvage receptor.

Exemplary half-life extending moieties that can be used, in accordance with the present invention, include an immunoglobulin Fc domain, or a portion thereof, or a biologically suitable polymer or copolymer, for example, a polyalkylene glycol compound, such as a polyethylene glycol (PEG) or a polypropylene glycol. Other appropriate polyalkylene glycol compounds include, but are not limited to, charged or neutral polymers of the following types: dextran, polylysine, colominic acids or other carbohydrate based polymers, polymers of amino acids, and biotin derivatives. In some monomeric fusion or conjugate protein embodiments an immunoglobulin (including light and heavy chains) or a portion thereof, can be used as a half-life-extending moiety, preferably an immunoglobulin of human origin, and including any of the immunoglobulins, such as, but not limited to, IgG1, IgG2, IgG3 or IgG4.

Other examples of the half-life extending moiety, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene maleic anhydride copolymer, a polyaminoacid (e.g., polylysine or polyornithine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, or a polysialic acid (e.g., PolyXen™ drug delivery technology; Gregoriadis et al., Improving the therapeutic efficacy of peptides and proteins: a role for polysialic acids, Intl. J. Pharmaceutics, 300:125-30 (2005), incorporated herein by reference in its entirety).

In other embodiments of the composition of matter, the half-life extending moiety is an anionically charged chemical entity, covalently linked to the N-terminus of the toxin peptide analog, which anionically charged chemical entities include, but are not limited to, phosphotyrosine, phosphoserine, p-phosphono(difluoro-methyl)-phenylalanine (Pfp), p-phosphono-methyl-phenylalanine (Pmp), p-phosphatidyl-phenylalanine (Ppa), or p-phosphono-methylketo-phenylalanine (Pkp), which can be covalently linked to the N-terminal of the toxin peptide analog, optionally indirectly, via an AEEA linker or other linker as described herein. (See, Chandy et al., Analogs of ShK toxin and their uses in selective inhibition of Kv1.3 potassium channels, WO 2006/042151 A2; Beeton et al., Targeting effector memory T cells with a selective peptide inhibitor of Kv1.3 channels for therapy of autoimmune diseases, Molec. Pharmacol. 67(4):1369-81 (2005); Pennington et al., Engineering a stable and selective peptide blocker of the Kv1.3 channel in T lymphocytes, Molecular Pharmacology Fast Forward, published Jan. 2, 2009 as doi:10.1124/mol.108.052704 (2009), all of which references are incorporated herein by reference in their entireties). AEEA is 2-(2-(2-aminoethoxy)ethoxy)acetic acid (also known as 8-Amino-3,6-Dioxaoctanoic Acid). (See, e.g., Beeton et al., Targeting effector memory T cells with a selective peptide inhibitor of Kv1.3 channels for therapy of autoimmune diseases, Molec. Pharmacol. 67(4):1369-81 (2005)).

Other embodiments of the half-life extending moiety, in accordance with the invention, include peptide ligands or small (organic) molecule ligands that have binding affinity for a long half-life serum protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life serum protein. (See, e.g., Blaney et al., Method and compositions for increasing the serum half-life of pharmacologically active agents by binding to transthyretin-selective ligands, U.S. Pat. No. 5,714,142; Sato et al., Serum albumin binding moieties, US 2003/0069395 A1; Jones et al., Pharmaceutical active conjugates, U.S. Pat. No. 6,342,225).

A "long half-life serum protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable half-life extending moiety, such as, but not limited to, those described herein, or the use of a combination of two or more different half-life extending moieties, such as PEG and immunoglobulin Fc domain or a portion thereof (see, e.g., Feige et al., Modified peptides as therapeutic agents, U.S. Pat. No. 6,660,843), such as a CH2 domain of Fc, albumin (e.g., human serum albumin (HSA); see, e.g., Rosen et al., Albumin fusion proteins, U.S. Pat. No. 6,926,898 and US 2005/0054051; Bridon et al., Protection of endogenous therapeutic peptides from peptidase activity through conjugation to blood components, U.S. Pat. No. 6,887,470), a transthyretin (TTR; see, e.g., Walker et al., Use of transthyretin peptide/protein fusions to increase the serum half-life of pharmacologically active peptides/proteins, US 2003/0195154 A1; 2003/0191056 A1), or a thyroxine-binding globulin (TBG), or a combination such as immunoglobulin(light chain+heavy chain) and Fc domain (the heterotrimeric combination a so-called "hemibody"), for example as described in Sullivan et al., Toxin Peptide Therapeutic Agents, PCT/US2007/022831, published as WO 2008/088422, which is incorporated herein by reference in its entirety.

Conjugation of the toxin peptide analogs(s) to the half-life extending moiety, or moieties, can be via the N-terminal and/or C-terminal of the toxin peptide, or can be intercalary as to its primary amino acid sequence, F1 being linked closer to the toxin peptide analog's N-terminus.

Particularly useful half-life extending moieties include immunoglobulins (e.g., human immunoglobulin, including IgG1, IgG2, IgG3 or IgG4). The term "immunoglobulin" encompasses full antibodies comprising two dimerized heavy chains (HC), each covalently linked to a light chain (LC); a single undimerized immunoglobulin heavy chain and covalently linked light chain (HC+LC); or a chimeric immunoglobulin (light chain+heavy chain)-Fc heterotrimer (a so-called "hemibody"). FIG. 12A-N and FIGS. 88-91 illustrate several different embodiments of such immunoglobulin-toxin peptide conjugates.

Recombinant fusion or chemical conjugation of the inventive GpTx-1 peptide analogs to a recombinant immunoglobulin of any of the IgG1, IgG2, IgG3 or IgG4 isotypes can be useful to extend pharmacokinetic half life. (See, e.g., Doellgast et al., WO 2010/108153 A2). Any of the carrier immunoglobulins disclosed in Doellgast et al., WO 2010/108153 A2 or Walker et al., PCT/US2011/052841, or isotype conversions of any of them comprising different isotype constant domains, or other carrier immunoglobulins known in the art, can be used as half life extending moieties within the scope of the invention.

One example of a human IgG2 heavy chain (HC) constant domain has the amino acid sequence:

SEQ. ID NO: 3090

```
ASTKGPSVFPLAPCSRSTSESTAALGCLVKDYFPEPVTVSWNSGALTSG

VHTFPAVLQSSGLYSLSSVVTVPSSNFGTQTYTCNVDHKPSNTKVDKTV

ERKCCVECPPCPAPPVAGPSVFLFPPKPKDTLMISRTPEVTCVVVDVSH
```

-continued

```
EDPEVQFNWYVDGVEVHNAKTKPREEQFNSTFRVVSVLTVVHQDWLNGK

EYKCKVSNKGLPAPIEKTISKTKGQPREPQVYTLPPSREEMTKNQVSLT

CLVKGFYPSDIAVEWESNGQPENNYKTTPPMLDSDGSFFLYSKLTVDKS

RWQQGNVFSCSVMHEALHNHYTQKSLSLSPGK//.
```

Constant region sequences of other IgG isotypes are known in the art for an IgG1, IgG2, IgG3, or IgG4 immunoglobulin isotype, if desired. In general, human IgG2 can be used for targets where effector functions are not desired, and human IgG1 in situations where such effector functions (e.g., antibody-dependent cytotoxicity (ADCC)) are desired. Human IgG3 has a relatively short half life and human IgG4 forms antibody "half-molecules." There are four known allotypes of human IgG1. The preferred allotype is referred to as "hIgG1z", also known as the "KEEM" allotype. Human IgG1 allotypes "hIgG1za" (KDEL), "hIgG1f" (REEM), and "hIgG1fa" are also useful; all appear to have ADCC effector function.

Human hIgG1z heavy chain (HC) constant domain has the amino acid sequence:

SEQ ID NO: 3091

```
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK//.
```

Human hIgG1za heavy chain (HC) constant domain has the amino acid sequence:

SEQ ID NO: 3092

```
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNVFSCSVMHEALHNHYTQKSLSLSPGK//.
```

Human hIgG1f heavy chain (HC) constant domain has the amino acid sequence:

SEQ ID NO: 3093

```
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSREEMTKNQ
```

-continued

VSLTCLVKGFYPSDIAVEWESNGQPENNYKTTPPVLDSDGSFFLYSKLT

VDKSRWQQGNVFSCSVMHEALHNHYTQKSLSLSPGK//.

Human hIgG1fa heavy chain (HC) constant domain has the amino acid sequence:

SEQ ID NO: 3094

ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDW

LNGKEYKCKVSNKALPAPIEKTISKAKGQPREPQVYTLPPSRDELTKNQ

VSLTCLVKGFYPSDIAVEWESNGQPENNYKTTPPVLDSDGSFFLYSKLT

VDKSRWQQGNVFSCSVMHEALHNHYTQKSLSLSPGK//.

One example of a human immunoglobulin light chain (LC) constant region sequence is the following (designated "CL-1"):

SEQ ID NO: 3095

GQPKANPTVTLFPPSSEELQANKATLVCLISDFYPGAVTVAWKADGSPV

KAGVETTKPSKQSNNKYAASSYLSLTPEQWKSHRSYSCQVTHEGSTVEK

TVAPTECS//.

CL-1 is useful to increase the pI of antibodies and is convenient. There are three other human immunoglobulin light chain constant regions, designated "CL-2", "CL-3" and "CL-7", which can also be used within the scope of the present invention. CL-2 and CL-3 are more common in the human population.

CL-2 human light chain (LC) constant domain has the amino acid sequence:

SEQ ID NO: 3096

GQPKAAPSVTLFPPSSEELQANKATLVCLISDFYPGAVTVAWKADSSPV

KAGVETTTPSKQSNNKYAASSYLSLTPEQWKSHRSYSCQVTHEGSTVEK

TVAPTECS//.

CL-3 human LC constant domain has the amino acid sequence:

SEQ ID NO: 3097

GQPKAAPSVTLFPPSSEELQANKATLVCLISDFYPGAVTVAWKADSSPV

KAGVETTTPSKQSNNKYAASSYLSLTPEQWKSHKSYSCQVTHEGSTVEK

TVAPTECS//.

CL-7 human LC constant domain has the amino acid sequence:

SEQ ID NO: 3098

GQPKAAPSVTLFPPSSEELQANKATLVCLVSDFYPGAVTVAWKADGSPV

KVGVETTKPSKQSNNKYAASSYLSLTPEQWKSHRSYSCRVTHEGSTVEK

TVAPAECS//.

Variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope or domain on the target protein, if any. From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.), or Chothia & Lesk, 1987, *J. Mol. Biol.* 196:901-917; Chothia et al., 1989, *Nature* 342:878-883.

An "antibody", or interchangeably "Ab", is a tetrameric glycoprotein. In a naturally-occurring antibody, each tetramer is composed of two identical pairs of polypeptide chains, each pair having one "light" chain of about 220 amino acids (about 25 kDa) and one "heavy" chain of about 440 amino acids (about 50-70 kDa). The amino-terminal portion of each chain includes a "variable" ("V") region of about 100 to 110 or more amino acids primarily responsible for antigen recognition. The carboxy-terminal portion of each chain defines a constant region primarily responsible for effector function. The variable region differs among different antibodies. The constant region is the same among different antibodies. Within the variable region of each heavy or light chain, there are three hypervariable subregions that help determine the antibody's specificity for antigen. The variable domain residues between the hypervariable regions are called the framework residues and generally are somewhat homologous among different antibodies. Immunoglobulins can be assigned to different classes depending on the amino acid sequence of the constant domain of their heavy chains. Human light chains are classified as kappa (κ) and lambda (λ) light chains. Within light and heavy chains, the variable and constant regions are joined by a "J" region of about 12 or more amino acids, with the heavy chain also including a "D" region of about 10 more amino acids. See generally, Fundamental Immunology, Ch. 7 (Paul, W., ed., 2nd ed. Raven Press, N.Y. (1989)). Within the scope of the invention, an "antibody" also encompasses a recombinantly made antibody, and antibodies that are lacking glycosylation.

The term "light chain" or "immunoglobulin light chain" includes a full-length light chain and fragments thereof having sufficient variable region sequence to confer binding specificity. A full-length light chain includes a variable region domain, VL, and a constant region domain, CL. The variable region domain of the light chain is at the amino-terminus of the polypeptide. Light chains include kappa chains and lambda chains. The term "heavy chain" or "immunoglobulin heavy chain" includes a full-length heavy chain and fragments thereof having sufficient variable region sequence to confer binding specificity. A full-length heavy chain includes a variable region domain, $V_H$, and three constant region domains, $C_H1$, $C_H2$, and $C_H3$. The $V_H$ domain is at the amino-terminus of the polypeptide, and the $C_H$ domains are at the carboxyl-terminus, with the $C_H3$ being closest to the carboxy-terminus of the polypeptide. Heavy chains are classified as mu (μ), delta (Δ), gamma (γ), alpha (α), and epsilon (ε), and define the antibody's isotype as IgM, IgD, IgG, IgA, and IgE, respectively. In separate embodiments of the invention, heavy chains may be of any isotype, including IgG (including IgG1, IgG2, IgG3 and IgG4 subtypes), IgA (including IgA1 and IgA2 subtypes), IgM and IgE. Several of these may be further divided into subclasses or isotypes, e.g. IgG1, IgG2, IgG3, IgG4, IgA1 and IgA2. The variable regions of each light/heavy chain pair typically form the antigen binding site of an antibody, but a useful carrier antibody need not have a known antigen binding site to be useful. (See, e.g., Doellgast et al., WO 2010/108153 A2; Walker et al., PCT/US2011/052841). Different IgG isotypes may have different effector functions (mediated by the Fc region), such as antibody-dependent cellular cytotoxicity (ADCC) and complement-dependent cytotoxicity (CDC). In ADCC, the Fc region of an antibody binds to Fc receptors (FcγRs) on the surface of immune effector cells such as natural killers and macrophages, leading to the phagocytosis or lysis of the targeted cells. In CDC, the antibodies kill the targeted cells by triggering the complement cascade at the cell surface.

An “Fc region”, or used interchangeably herein, “Fc domain” or “immunoglobulin Fc domain”, contains two heavy chain fragments, which in a full antibody comprise the $C_H1$ and $C_H2$ domains of the antibody. The two heavy chain fragments are held together by two or more disulfide bonds and by hydrophobic interactions of the $C_H3$ domains.

The term “salvage receptor binding epitope” refers to an epitope of the Fc region of an IgG molecule (e.g., $IgG_1$, $IgG_2$, $IgG_3$, or $IgG_4$) that is responsible for increasing the in vivo serum half-life of the IgG molecule.

“Allotypes” are variations in antibody sequence, often in the constant region, that can be immunogenic and are encoded by specific alleles in humans. Allotypes have been identified for five of the human IGHC genes, the IGHG1, IGHG2, IGHG3, IGHA2 and IGHE genes, and are designated as G1m, G2m, G3m, A2m, and Em allotypes, respectively. At least 18 Gm allotypes are known: nG1m(1), nG1m(2), G1m (1, 2, 3, 17) or G1m (a, x, f, z), G2m (23) or G2m (n), G3m (5, 6, 10, 11, 13, 14, 15, 16, 21, 24, 26, 27, 28) or G3m (b1, c3, b5, b0, b3, b4, s, t, g1, c5, u, v, g5). There are two A2m allotypes A2m(1) and A2m(2).

For a detailed description of the structure and generation of antibodies, see Roth, D. B., and Craig, N. L., *Cell,* 94:411-414 (1998), herein incorporated by reference in its entirety. Briefly, the process for generating DNA encoding the heavy and light chain immunoglobulin sequences occurs primarily in developing B-cells. Prior to the rearranging and joining of various immunoglobulin gene segments, the V, D, J and constant (C) gene segments are found generally in relatively close proximity on a single chromosome. During B-cell-differentiation, one of each of the appropriate family members of the V, D, J (or only V and J in the case of light chain genes) gene segments are recombined to form functionally rearranged variable regions of the heavy and light immunoglobulin genes. This gene segment rearrangement process appears to be sequential. First, heavy chain D-to-J joints are made, followed by heavy chain V-to-DJ joints and light chain V-to-J joints. In addition to the rearrangement of V, D and J segments, further diversity is generated in the primary repertoire of immunoglobulin heavy and light chains by way of variable recombination at the locations where the V and J segments in the light chain are joined and where the D and J segments of the heavy chain are joined. Such variation in the light chain typically occurs within the last codon of the V gene segment and the first codon of the J segment. Similar imprecision in joining occurs on the heavy chain chromosome between the D and $J_H$ segments and may extend over as many as 10 nucleotides. Furthermore, several nucleotides may be inserted between the D and $J_H$ and between the $V_H$ and D gene segments which are not encoded by genomic DNA. The addition of these nucleotides is known as N-region diversity. The net effect of such rearrangements in the variable region gene segments and the variable recombination which may occur during such joining is the production of a primary antibody repertoire.

The term “hypervariable” region refers to the amino acid residues of an antibody which are responsible for antigen-binding. The hypervariable region comprises amino acid residues from a complementarity determining region or CDR [i.e., residues 24-34 (L1), 50-56 (L2) and 89-97 (L3) in the light chain variable domain and 31-35 (H1), 50-65 (H2) and 95-102 (H3) in the heavy chain variable domain as described by Kabat et al., Sequences of Proteins of Immunological Interest, $5^{th}$ Ed. Public Health Service, National Institutes of Health, Bethesda, Md. (1991)]. Even a single CDR may recognize and bind antigen, although with a lower affinity than the entire antigen binding site containing all of the CDRs.

An alternative definition of residues from a hypervariable “loop” is described by Chothia et al., *J. Mol. Biol.* 196: 901-917 (1987) as residues 26-32 (L1), 50-52 (L2) and 91-96 (L3) in the light chain variable domain and 26-32 (H1), 53-55 (H2) and 96-101 (H3) in the heavy chain variable domain.

“Framework” or “FR” residues are those variable region residues other than the hypervariable region residues.

“Antibody fragments” comprise a portion of an intact full length antibody, preferably the antigen binding or variable region of the intact antibody. Examples of antibody fragments include Fab, Fab', $F(ab')_2$, and Fv fragments; diabodies; linear antibodies (Zapata et al., Protein Eng., 8(10):1057-1062 (1995)); single-chain antibody molecules; and multispecific antibodies formed from antibody fragments.

Papain digestion of antibodies produces two identical antigen-binding fragments, called “Fab” fragments, each with a single antigen-binding site, and a residual “Fc” fragment which contains the constant region. The Fab fragment contains all of the variable domain, as well as the constant domain of the light chain and the first constant domain (CH1) of the heavy chain. The Fc fragment displays carbohydrates and is responsible for many antibody effector functions (such as binding complement and cell receptors), that distinguish one class of antibody from another.

Pepsin treatment yields an $F(ab')_2$ fragment that has two “Single-chain Fv” or “scFv” antibody fragments comprising the VH and VL domains of antibody, wherein these domains are present in a single polypeptide chain. Fab fragments differ from Fab' fragments by the inclusion of a few additional residues at the carboxy terminus of the heavy chain CH1 domain including one or more cysteines from the antibody hinge region. Preferably, the Fv polypeptide further comprises a polypeptide linker between the VH and VL domains that enables the Fv to form the desired structure for antigen binding. For a review of scFv see Pluckthun in The Pharmacology of Monoclonal Antibodies, vol. 113, Rosenburg and Moore eds., Springer-Verlag, New York, pp. 269-315 (1994).

A “Fab fragment” is comprised of one light chain and the $C_H1$ and variable regions of one heavy chain. The heavy chain of a Fab molecule cannot form a disulfide bond with another heavy chain molecule.

A “Fab' fragment” contains one light chain and a portion of one heavy chain that contains the $V_H$ domain and the $C_H1$ domain and also the region between the $C_H1$ and $C_H2$ domains, such that an interchain disulfide bond can be formed between the two heavy chains of two Fab' fragments to form an $F(ab')_2$ molecule.

A “$F(ab')_2$ fragment” contains two light chains and two heavy chains containing a portion of the constant region between the $C_H1$ and $C_H2$ domains, such that an interchain disulfide bond is formed between the two heavy chains. A $F(ab')_2$ fragment thus is composed of two Fab' fragments that are held together by a disulfide bond between the two heavy chains.

"Fv" is the minimum antibody fragment that contains a complete antigen recognition and binding site. This region consists of a dimer of one heavy- and one light-chain variable domain in tight, non-covalent association. It is in this configuration that the three CDRs of each variable domain interact to define an antigen binding site on the surface of the VH VL dimer. A single variable domain (or half of an Fv comprising only three CDRs specific for an antigen) has the ability to recognize and bind antigen, although at a lower affinity than the entire binding site.

"Single-chain antibodies" are Fv molecules in which the heavy and light chain variable regions have been connected by a flexible linker to form a single polypeptide chain, which forms an antigen-binding region. Single chain antibodies are discussed in detail in International Patent Application Publication No. WO 88/01649 and U.S. Pat. No. 4,946,778 and U.S. Pat. No. 5,260,203, the disclosures of which are incorporated by reference in their entireties.

"Single-chain Fv" or "scFv" antibody fragments comprise the $V_H$ and $V_L$ domains of antibody, wherein these domains are present in a single polypeptide chain, and optionally comprising a polypeptide linker between the $V_H$ and $V_L$ domains that enables the Fv to form the desired structure for antigen binding (Bird et al., *Science* 242:423-426, 1988, and Huston et al., *Proc. Natl. Acad. Sci. USA* 85:5879-5883, 1988). An "Fd" fragment consists of the $V_H$ and $C_H1$ domains.

The term "diabodies" refers to small antibody fragments with two antigen-binding sites, which fragments comprise a heavy-chain variable domain (VH) connected to a light-chain variable domain (VL) in the same polypeptide chain (VH VL). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90:6444-6448 (1993).

A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody may target the same or different antigens.

The term "epitope" is the portion of a molecule that is bound by an antigen binding protein (for example, an antibody). The term includes any determinant capable of specifically binding to an antigen binding protein, such as an antibody or to a T-cell receptor. An epitope can be contiguous or non-contiguous (e.g., in a single-chain polypeptide, amino acid residues that are not contiguous to one another in the polypeptide sequence but that within the context of the molecule are bound by the antigen binding protein). In certain embodiments, epitopes may be mimetic in that they comprise a three dimensional structure that is similar to an epitope used to generate the antigen binding protein, yet comprise none or only some of the amino acid residues found in that epitope used to generate the antigen binding protein. Most often, epitopes reside on proteins, but in some instances may reside on other kinds of molecules, such as nucleic acids. Epitope determinants may include chemically active surface groupings of molecules such as amino acids, sugar side chains, phosphoryl or sulfonyl groups, and may have specific three dimensional structural characteristics, and/or specific charge characteristics. Generally, antibodies specific for a particular target antigen will preferentially recognize an epitope on the target antigen in a complex mixture of proteins and/or macromolecules.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York: Academic Press; Sequence Analysis Primer, (Gribskov, M. and Devereux, J., eds.), 1991, New York: M. Stockton Press; and Carillo et al., 1988, SIAM J. Applied Math. 48:1073. For example, sequence identity can be determined by standard methods that are commonly used to compare the similarity in position of the amino acids of two polypeptides. Using a computer program such as BLAST or FASTA, two polypeptide or two polynucleotide sequences are aligned for optimal matching of their respective residues (either along the full length of one or both sequences, or along a pre-determined portion of one or both sequences). The programs provide a default opening penalty and a default gap penalty, and a scoring matrix such as PAM 250 [a standard scoring matrix; see Dayhoff et al., in *Atlas of Protein Sequence and Structure*, vol. 5, supp. 3 (1978)] can be used in conjunction with the computer program. For example, the percent identity can then be calculated as: the total number of identical matches multiplied by 100 and then divided by the sum of the length of the longer sequence within the matched span and the number of gaps introduced into the longer sequences in order to align the two sequences. In calculating percent identity, the sequences being compared are aligned in a way that gives the largest match between the sequences.

The GCG program package is a computer program that can be used to determine percent identity, which package includes GAP (Devereux et al., 1984, Nucl. Acid Res. 12:387; Genetics Computer Group, University of Wisconsin, Madison, Wis.). The computer algorithm GAP is used to align the two polypeptides or two polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix;

Henikoff et al., 1992, Proc. Natl. Acad. Sci. U.S.A. 89:10915-10919 for the BLOSUM 62 comparison matrix) is also used by the algorithm.

Recommended parameters for determining percent identity for polypeptides or nucleotide sequences using the GAP program include the following:

Algorithm: Needleman et al., 1970, J. Mol. Biol. 48:443-453;
Comparison matrix: BLOSUM 62 from Henikoff et al., 1992, supra;
Gap Penalty: 12 (but with no penalty for end gaps)
Gap Length Penalty: 4
Threshold of Similarity: 0

Certain alignment schemes for aligning two amino acid sequences may result in matching of only a short region of the two sequences, and this small aligned region may have very high sequence identity even though there is no significant relationship between the two full-length sequences. Accordingly, the selected alignment method (GAP program) can be adjusted if so desired to result in an alignment that spans at least 50 contiguous amino acids of the target polypeptide.

The term "modification" when used in connection with immunoglobulins, including antibodies and antibody fragments, of the invention, include, but are not limited to, one or more amino acid changes (including substitutions, insertions or deletions); chemical modifications; covalent modification by conjugation to therapeutic or diagnostic agents; labeling (e.g., with radionuclides or various enzymes); covalent polymer attachment such as PEGylation (derivatization with polyethylene glycol) and insertion or substitution by chemical synthesis of non-natural amino acids.

The term "derivative" when used in connection with an immunoglobulin (including antibodies and antibody fragments) within the scope of the invention refers to immunoglobulin proteins that are covalently modified by conjugation to therapeutic or diagnostic agents, labeling (e.g., with radionuclides or various enzymes), covalent polymer attachment such as PEGylation (derivatization with polyethylene glycol) and insertion or substitution by chemical synthesis of non-natural amino acids. Derivatives of the invention will retain the binding properties of underivatized molecules of the invention.

In some embodiments of the invention, the half-life extending moiety is an immunoglobulin Fc domain (e.g., a human immunoglobulin Fc domain, including Fc of allotype IgG1, IgG2, IgG3 or IgG4) or a portion thereof (e.g., CH2 domain of the Fc domain), human serum albumin (HSA), or poly(ethylene glycol) (PEG), in particular PEG of molecular weight of about 1000 Da to about 100000 Da.

Figure 2:
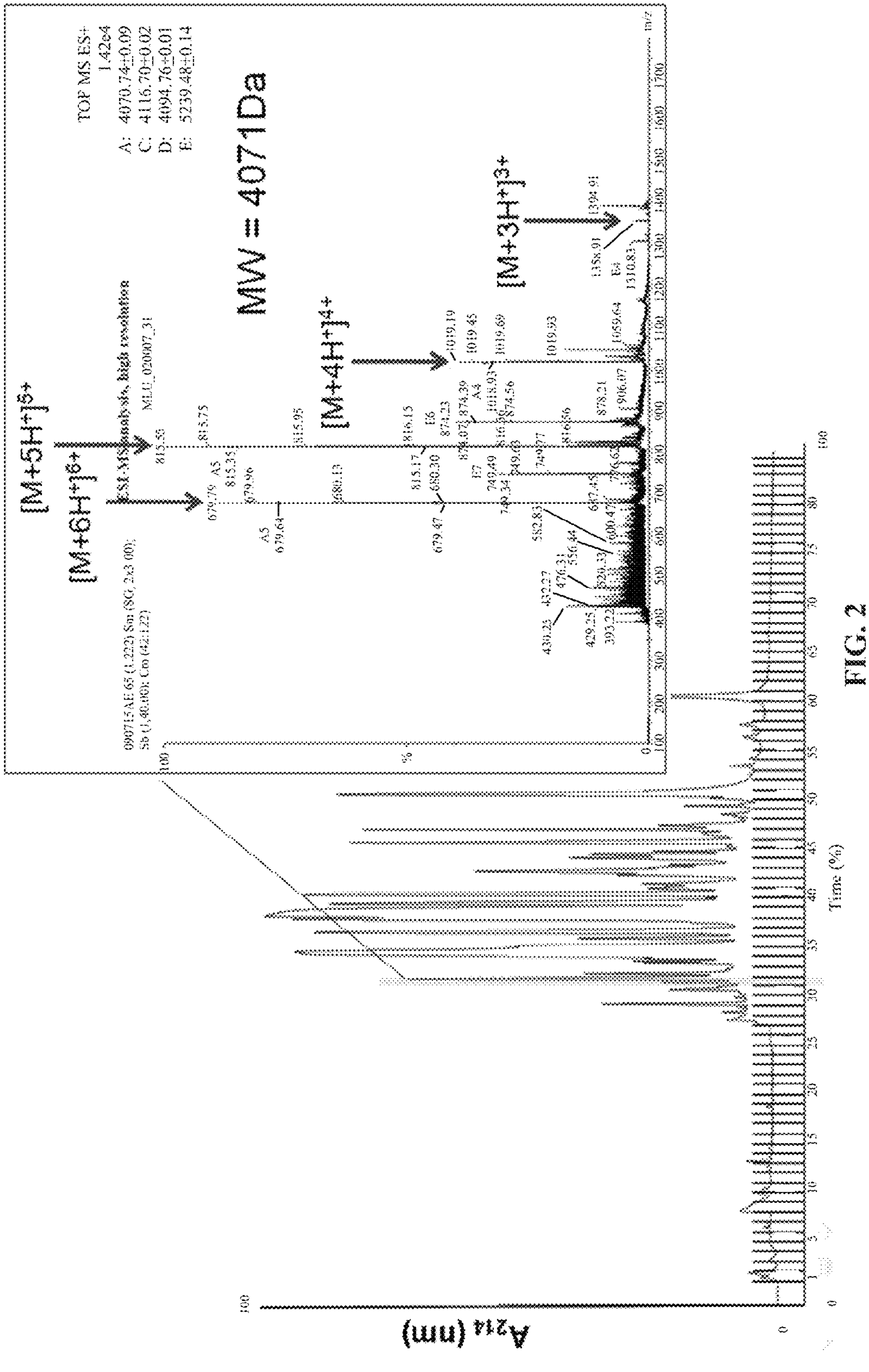
FIG. 2 (inset) shows the high resolution electrospray ionization-mass spectrometry (ESI-MS) analysis of the indicated fraction (31) from the initial separation of *Grammostola porteri* venom. The arrows indicate the (m/z) ratios observed for the different ionization states of a peptide with a molecular weight of 4071 Da that was eventually identified as GpTx-1. Additional peaks in the mass spectrum indicate that the venom fraction is a mixture of at least four distinct peptides.

Monovalent dimeric or bivalent dimeric Fc-toxin peptide analog fusions or conjugates are useful embodiments of the inventive composition of matter. A "monovalent dimeric" Fc-toxin peptide analog fusion or conjugate, or interchangeably, "monovalent dimer", or interchangeably, "monovalent heterodimer", is a Fc-toxin peptide analog fusion or conjugate that includes a toxin peptide analog conjugated with only one of the dimerized Fc domains (e.g., as represented schematically in FIG. 2B of Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties). A "bivalent dimeric" Fc-toxin peptide analog fusion, or interchangeably, "bivalent dimer" or "bivalent homodimer", is a Fc-toxin peptide analog fusion or conjugate having both of the dimerized Fc domains each conjugated separately with a toxin peptide analog (e.g., as represented schematically in FIG. 2C of Sullivan et al., Toxin Peptide Therapeutic Agents, US2007/0071764 and Sullivan et al., Toxin Peptide Therapeutic Agents, PCT/US2007/022831, published as WO 2008/088422).

Immunoglobulin Fc domains include Fc variants, which are suitable half-life extending moieties within the scope of this invention. A native Fc can be extensively modified to form an Fc variant in accordance with this invention, provided binding to the salvage receptor is maintained; see, for example WO 97/34631, WO 96/32478, and WO 04/110 472. In such Fc variants, one can remove one or more sites of a native Fc that provide structural features or functional activity not required by the fusion or conjugate molecules of this invention. One can remove these sites by, for example, substituting or deleting residues, inserting residues into the site, or truncating portions containing the site. The inserted or substituted residues can also be altered amino acids, such as peptidomimetics or D-amino acids. Fc variants can be desirable for a number of reasons, several of which are described below. Exemplary Fc variants include molecules and sequences in which:

1. Sites involved in disulfide bond formation are removed. Such removal can avoid reaction with other cysteine-containing proteins present in the host cell used to produce the molecules of the invention. For this purpose, the cysteine-containing segment at the N-terminus can be truncated or cysteine residues can be deleted or substituted with other amino acids (e.g., alanyl, seryl). In particular, one can truncate the N-terminal 20-amino acid segment of SEQ ID NO: 478:

```
                                        SEQ ID NO: 478
Met Glu Trp Ser Trp Val Phe Leu Phe Phe Leu

Ser Val Thr Thr Gly Val His Ser Asp Lys Thr His

Thr Cys Pro Pro Cys Pro Ala Pro Glu Leu Leu

Gly Gly Pro Ser Val Phe Leu Phe Pro Pro Lys

Pro Lys Asp Thr Leu Met Ile Ser Arg Thr Pro

Glu Val Thr Cys Val Val Val Asp Val Ser His

Glu Asp Pro Glu Val Lys Phe Asn Trp Tyr Val

Asp Gly Val Glu Val His Asn Ala Lys Thr Lys

Pro Arg Glu Glu Gln Tyr Asn Ser Thr Tyr Arg

Val Val Ser Val Leu Thr Val Leu His Gln Asp

Trp Leu Asn Gly Lys Glu Tyr Lys Cys Lys Val

Ser Asn Lys Ala Leu Pro Ala Pro Ile Glu Lys

Thr Ile Ser Lys Ala Lys Gly Gln Pro Arg Glu

Pro Gln Val Tyr Thr Leu Pro Pro Ser Arg Asp

Glu Leu Thr Lys Asn Gln Val Ser Leu Thr Cys

Leu Val Lys Gly Phe Tyr Pro Ser Asp Ile Ala

Val Glu Trp Glu Ser Asn Gly Gln Pro Glu Asn

Asn Tyr Lys Thr Thr Pro Pro Val Leu Asp Ser

Asp Gly Ser Phe Phe Leu Tyr Ser Lys Leu

Thr Val Asp Lys Ser Arg Trp Gln Gln Gly Asn

Val Phe Ser Cys Ser Val Met His Glu Ala

Leu His Asn His Tyr Thr Gln Lys Ser Leu

Ser Leu Ser Pro Gly Lys//.
```

or delete or substitute the cysteine residues at positions 7 and 10 of SEQ ID NO: 478. Even when cysteine residues are removed, the single chain Fc domains can still form a dimeric Fc domain that is held together non-covalently.

2. A native Fc is modified to make it more compatible with a selected host cell. For example, one can remove the PA dipeptide sequence near the N-terminus of a typical native Fc, which can be recognized by a digestive enzyme in *E. coli* such as proline iminopeptidase. One can also add an N-terminal methionine residue, especially when the molecule is expressed recombinantly in a bacterial cell such as *E. coli*. The Fc domain of SEQ ID NO: 478 is one such Fc variant.

3. A portion of the N-terminus of a native Fc is removed to prevent N-terminal heterogeneity when expressed in a selected host cell. For this purpose, one can delete any of the first 20 amino acid residues at the N-terminus, particularly those at positions 1, 2, 3, 4 and 5.

4. One or more glycosylation sites are removed. Residues that are typically glycosylated (e.g., asparagine) can confer cytolytic response. Such residues can be deleted or substituted with unglycosylated residues (e.g., alanine).

5. Sites involved in interaction with complement, such as the C1q binding site, are removed. For example, one can delete or substitute the EKK tripeptide sequence of human IgG1. Complement recruitment may not be advantageous for the molecules of this invention and so can be avoided with such an Fc variant.

5. Sites are removed that affect binding to Fc receptors other than a salvage receptor. A native Fc can have sites for interaction with certain white blood cells that are not required for the fusion or conjugate molecules of the present invention and so can be removed.

7. The ADCC site is removed to decrease or eliminate ADCC effector function, or alternatively, modified for enhanced ADCC effector function by non-fucosylation or de-fucosylation. ADCC sites are known in the art; see, for example, *Molec. Immunol.* 29 (5): 633-9 (1992) with regard to ADCC sites in IgG1. These sites, as well, are not required for the fusion or conjugate molecules of the present invention and so can be removed, or enhanced for ADCC effector function, as may be desired. (See, Iida et al., Two mechanisms of the enhanced antibody-dependent cellular cytotoxicity (ADCC) efficacy of non-fucosylated therapeutic antibodies in human blood, BMC Cancer 9:58 doi:10.1186/1471-2407-9-58 (2009)).

8. When the native Fc is derived from a non-human antibody, the native Fc can be humanized. Typically, to humanize a native Fc, one will substitute selected residues in the non-human native Fc with residues that are normally found in human native Fc. Techniques for antibody humanization are well known in the art.

9. One or more toxin peptide analog sequences can be inserted into an internal conjugation site, or sites, within a loop region of an immunoglobulin Fc domain, as disclosed in U.S. Pat. Nos. 7,442,778; 7,645,861; 7,655,764; 7,655,765; 7,662,931; 7,750,127, and 7,750,128. The term "loop" region or "Fc-loop" region refers to a primary sequence of amino acid residues which connects two regions comprising secondary structure, such as an α-helix or a β-sheet, in the immediate N-terminal and C-terminal directions of primary structure from the loop region. Examples include, but are not limited to, CH2 or CH3 loop regions. One of skill in the art understands that a loop region, while not itself comprising secondary structure, may influence or contribute to secondary or higher order protein structure. The term "internal" conjugation site means that the toxin peptide analog moiety, or moieties, is non-terminal, i.e., not through the α-amino site or the α-carboxy site of the Fc domain, although there optionally can also be additional moieties conjugated terminally at the N-terminal and/or C-terminal of the Fc domain.

10. A linker of suitable length and neutral charge, such as "L25" (GGGGSGGGGSGGGGSGGGGSGGGGS; SEQ ID NO:493) or "L20" (GGGGSGGGGSGGGGSGGGGS; SEQ ID NO:477), can be covalently fused between the C-terminal of one monomer of an Fc domain and the N-terminal of a second Fc domain monomer, with a toxin peptide analog fused to the N-terminal of the first Fc domain monomer or the C-terminal of the second Fc domain monomer, or within a loop region of the first and/or second Fc domain monomer. Such a molecule can be recombinantly expressed in bacterial or mammalian cells to produce a variant "monovalent dimeric" Fc-toxin peptide analog fusion or conjugate with the typical disulfide bond formation between the Fc monomers. (See, e.g., Example 13 herein). Other examples of Fc variants include the following: In SEQ ID NO: 478, the leucine at position 15 can be substituted with glutamate; the glutamate at position 99, with alanine; and the lysines at positions 101 and 103, with alanines. In addition, phenyalanine residues can replace one or more tyrosine residues. For purposes of the invention, a variant Fc domain can also be part of a monomeric immunoglobulin heavy chain, an antibody, or a heterotrimeric hemibody (LC+HC+Fc).

An alternative half-life extending moiety would be a protein, polypeptide, peptide, antibody, antibody fragment, or small molecule (e.g., a peptidomimetic compound) capable of binding to a salvage receptor. For example, one could use as a half-life extending moiety a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "half-life extending moiety" and are within the scope of this invention. Such half-life extending moieties should be selected for increased half-life (e.g., by avoiding sequences recognized by proteases) and decreased immunogenicity (e.g., by favoring non-immunogenic sequences, as discovered in antibody humanization).

As noted above, polymer half-life extending moieties can also be used. Various means for attaching chemical moieties useful as half-life extending moieties are currently available, see, e.g., Patent Cooperation Treaty ("PCT") International Publication No. WO 96/11953, entitled "N-Terminally Chemically Modified Protein Compositions and Methods," herein incorporated by reference in its entirety. This PCT publication discloses, among other things, the selective attachment of water-soluble polymers to the N-terminus of proteins.

In some embodiments of the inventive compositions, the polymer half-life extending moiety is polyethylene glycol (PEG), covalently linked at the N-terminal, C-terminal or at one or more intercalary side chains of toxin peptide analog. Some embodiments of the inventive composition of matter further include one or more PEG moieties conjugated to a non-PEG half-life extending moiety or to the toxin peptide analog, or to any combination of any of these. For example, an Fc domain or portion thereof in the inventive composition can be made mono-PEGylated, di-PEGylated, or otherwise multi-PEGylated, by the process of reductive alkylation.

Covalent conjugation of proteins and peptides with poly (ethylene glycol) (PEG) has been widely recognized as an approach to significantly extend the in vivo circulating half-lives of therapeutic proteins. PEGylation achieves this effect predominately by retarding renal clearance, since the PEG moiety adds considerable hydrodynamic radius to the protein. (Zalipsky, S., et al., Use of functionalized poly(ethylene glycol)s for modification of polypeptides, in poly(ethylene glycol) chemistry: Biotechnical and biomedical applications, J. M. Harris, Ed., Plenum Press: New York, 347-370 (1992)). Additional benefits often conferred by PEGylation of proteins and peptides include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials.

By "PEGylated peptide" or "PEGylated protein" is meant a peptide having a polyethylene glycol (PEG) moiety covalently bound to an amino acid residue of the peptide itself or to a peptidyl or non-peptidyl linker that is covalently bound to a residue of the peptide, either directly or indirectly through another linker moiety. A non-limiting example is N-terminal conjugation of the peptide with 3-(1-(1-bromo-2-oxo-6,9,12,15,18,21,24,27,30,33,36-undecaoxa-3-azaoctatriacontan-38-yl)-1H-1,2,3-triazol-4-yl)propanoyl (designated herein by the abbreviation "{bromoacetamide-PEG1'-triazole}-").

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with the present invention, useful PEG includes substantially linear, straight chain PEG, branched PEG (brPEG), or dendritic PEG. (See, e.g., Merrill, U.S. Pat. No. 5,171,264; Harris et al., Multiarmed, monofunctional, polymer for coupling to molecules and surfaces, U.S. Pat. No. 5,932,462; Shen, N-maleimidyl polymer derivatives, U.S. Pat. No. 6,602,498).

Briefly, the PEG groups are generally attached to the peptide portion of the composition of the invention via acylation or reductive alkylation (or reductive amination) through a reactive group on the PEG moiety (e.g., an aldehyde, amino, thiol, or ester group) to a reactive group on the inventive compound (e.g., an aldehyde, amino, or ester group). A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis (see, for example, FIGS. 5 and 6 and the accompanying text herein). The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

PEG is a well-known, water soluble polymer that is commercially available or can be prepared by ring-opening polymerization of ethylene glycol according to methods well known in the art (Sandler and Karo, Polymer Synthesis, Academic Press, New York, Vol. 3, pages 138-161). In the present application, the term "PEG" is used broadly to encompass any polyethylene glycol molecule, in mono-, bi-, or polyfunctional form, without regard to size or to modification at an end of the PEG, and can be represented by the formula:

$$X—O(CH_2CH_2O)_{n-1}CH_2CH_2OH, \quad (I)$$

where n is 20 to 2300 and X is H or a terminal modification, e.g., a $C_{1-4}$ alkyl.

In some useful embodiments, a PEG used in the invention terminates on one end with hydroxy or methoxy, i.e., X is H or $CH_3$ ("methoxy PEG"). It is noted that the other end of the PEG, which is shown in formula (I) terminating in OH, covalently attaches to an activating moiety via an ether oxygen bond, an amine linkage, or amide linkage. When used in a chemical structure, the term "PEG" includes the formula (I) above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

$$(PEG)\text{-}(A) \quad (II)$$

where PEG (defined supra) covalently attaches to a carbon atom of the activation moiety (A) to form an ether bond, an amine linkage, or amide linkage, and (A) contains a reactive group which can react with an amino, azido, alkyne, imino, maleimido, N-succinimidyl, carboxyl, aminooxy, seleno, or thiol group on an amino acid residue of a peptide or a linker moiety covalently attached to the peptide, e.g., the toxin peptide analog.

Techniques for the preparation of activated PEG and its conjugation to biologically active peptides are well known in the art. (E.g., see U.S. Pat. Nos. 5,643,575, 5,919,455, 5,932,462, and 5,990,237; Kinstler et al., N-terminally chemically modified protein compositions and methods, U.S. Pat. Nos. 5,985,265, and 5,824,784; Thompson et al., PEGylation of polypeptides, EP 0575545 B1; Petit, Site specific protein modification, U.S. Pat. Nos. 6,451,986, and 6,548,644; S. Herman et al., Poly(ethylene glycol) with reactive endgroups: I. Modification of proteins, J. Bioactive Compatible Polymers, 10:145-187 (1995); Y. Lu et al., PEGylated peptides III: Solid-phase synthesis with PEGylating reagents of varying molecular weight: synthesis of multiply PEGylated peptides, Reactive Polymers, 22:221-229 (1994); A. M. Felix et al., PEGylated Peptides IV: Enhanced biological activity of site-directed PEGylated GRF analogs, Int. J. Peptide Protein Res., 46:253-264 (1995); A. M. Felix, Site-specific poly(ethylene glycol)ylation of peptides, ACS Symposium Series 680(poly(ethylene glycol)): 218-238 (1997); Y. Ikeda et al., Polyethylene glycol derivatives, their modified peptides, methods for producing them and use of the modified peptides, EP 0473084 B1; G. E. Means et al., Selected techniques for the modification of protein side chains, in: Chemical modification of proteins, Holden Day, Inc., 219 (1971)).

Activated PEG, such as PEG-aldehydes or PEG-aldehyde hydrates, can be chemically synthesized by known means or obtained from commercial sources, e.g., Shearwater Polymers, (Huntsville, Ala.) or Enzon, Inc. (Piscataway, N.J.).

An example of a useful activated PEG for purposes of the present invention is a PEG-aldehyde compound (e.g., a methoxy PEG-aldehyde), such as PEG-propionaldehyde, which is commercially available from Shearwater Polymers (Huntsville, Ala.). PEG-propionaldehyde is represented by the formula PEG-$CH_2CH_2CHO$. (See, e.g., U.S. Pat. No. 5,252,714). Also included within the meaning of "PEG aldehyde compound" are PEG aldehyde hydrates, e.g., PEG acetaldehyde hydrate and PEG bis aldehyde hydrate, which latter yields a bifunctionally activated structure. (See, e.g., Bentley et al., Poly(ethylene glycol) aldehyde hydrates and related polymers and applications in modifying amines, U.S. Pat. No. 5,990,237) (See, e.g., Bentley et al., Poly(ethylene glycol) aldehyde hydrates and related polymers and applications in modifying amines, U.S. Pat. No. 5,990,237). An activated multi-branched PEG-aldehyde compound can be used (PEG derivatives comprising multiple arms to give divalent, trivalent, tetravalent, octavalent constructs). Using a 4-arm PEG derivative four (4) toxin peptide analogs are attached to each PEG molecule. For example, in accordance with the present invention, the toxin peptide analog can be conjugated to a polyethylene glycol (PEG) at 1, 2, 3 or 4 amino functionalized sites of the PEG.

In being conjugated in accordance with the inventive method, the polyethylene glycol (PEG), as described herein, is covalently bound by reductive amination directly to at least one solvent-exposed free amine moiety of an amino acid residue of the toxin peptide analog itself. In some embodiments of the inventive method, the toxin peptide analog is conjugated to a PEG at one or more primary or secondary amines on the toxin peptide analog, or to two PEG groups at a single primary amine site on the toxin peptide analog (e.g., this can occur when the reductive amination reaction involves the presence of excess PEG-aldehyde compound). We have observed that when PEGylation by reductive amination is at a primary amine on the peptide, it is not uncommon to have amounts (1 to 100% range) of reaction product that have two or more PEGs present per molecule, and if the desired PEGylation product is one with only one PEG per molecule, then this "over-PEGylation" may be undesirable. When PEGylated product with a single PEG per PEGylation product molecule is desired, an embodiment of the inventive method can be employed that involves PEGylation using secondary amines of the pharmacologically active peptide, because only one PEG group per molecule will be transferred in the reductive amination reaction.

Amino acid residues that can provide a primary amine moiety include residues of lysine, homolysine, ornithine, a, β-diaminopropionic acid (Dap), α,β-diaminopropionoic acid (Dpr), and α,γ-diaminobutyric acid (Dab), aminobutyric acid (Abu), and α-amino-isobutyric acid (Aib). The polypeptide N-terminus also provides a useful α-amino group for PEGylation. Amino acid residues that can provide a secondary amine moiety include ε-N-alkyl lysine, α-N-alkyl lysine, δ-N-alkyl ornithine, α-N-alkyl ornithine, or an N-terminal proline, where the alkyl is $C_1$ to $C_6$.

Another useful activated PEG for generating the PEGylated toxin peptide analogs of the present invention is a PEG-maleimide compound, such as, but not limited to, a methoxy PEG-maleimide, such as maleimido monomethoxy PEG, are particularly useful for generating the PEG-conjugated peptides of the invention. (E.g., Shen, N-maleimidyl polymer derivatives, U.S. Pat. No. 6,602,498; C. Delgado et al., The uses and properties of PEG-linked proteins, Crit. Rev. Therap. Drug Carrier Systems, 9:249-304 (1992); S. Zalipsky et al., Use of functionalized poly(ethylene glycol)s for modification of polypeptides, in: Poly(ethylene glycol) chemistry: Biotechnical and biomedical applications (J. M. Harris, Editor, Plenum Press: New York, 347-370 (1992); S. Herman et al., Poly(ethylene glycol) with reactive endgroups: I. Modification of proteins, J. Bioactive Compatible Polymers, 10:145-187 (1995); P. J. Shadle et al., Conjugation of polymer to colony stimulating factor-1, U.S. Pat. No. 4,847,325; G. Shaw et al., Cysteine added variants IL-3 and chemical modifications thereof, U.S. Pat. No. 5,166,322 and EP 0469074 B1; G. Shaw et al., Cysteine added variants of EPO and chemical modifications thereof, EP 0668353 A1; G. Shaw et al., Cysteine added variants G-CSF and chemical modifications thereof, EP 0668354 A1; N. V. Katre et al., Interleukin-2 muteins and polymer conjugation thereof, U.S. Pat. No. 5,206,344; R. J. Goodson and N. V. Katre, Site-directed pegylation of recombinant interleukin-2 at its glycosylation site, Biotechnology, 8:343-346 (1990)).

A poly(ethylene glycol) vinyl sulfone is another useful activated PEG for generating the PEG-conjugated toxin peptide analogs of the present invention by conjugation at thiolated amino acid residues, e.g., at C residues. (E.g., M. Morpurgo et al., Preparation and characterization of poly (ethylene glycol) vinyl sulfone, Bioconj. Chem., 7:363-368 (1996); see also Harris, Functionalization of polyethylene glycol for formation of active sulfone-terminated PEG derivatives for binding to proteins and biologically compatible materials, U.S. Pat. Nos. 5,446,090; 5,739,208; 5,900,461; 6,610,281 and 6,894,025; and Harris, Water soluble active sulfones of poly(ethylene glycol), WO 95/13312 A1). Another activated form of PEG that is useful in accordance with the present invention, is a PEG-N-hydroxysuccinimide ester compound, for example, methoxy PEG-N-hydroxysuccinimidyl (NHS) ester.

Heterobifunctionally activated forms of PEG are also useful. (See, e.g., Thompson et al., PEGylation reagents and biologically active compounds formed therewith, U.S. Pat. No. 6,552,170).

In still other embodiments of the inventive method of producing a composition of matter, the toxin peptide analog is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, Poly(ethylene glycol) with Reactive Endgroups: I. Modification of Proteins, J. Bioactive and Compatible Polymers, 10:145-187 (1995); S. Zalipsky, Chemistry of Polyethylene Glycol Conjugates with Biologically Active Molecules, Advanced Drug Delivery Reviews, 16:157-182 (1995); R. Greenwald et al., Poly(ethylene glycol) conjugated drugs and prodrugs: a comprehensive review, Critical Reviews in Therapeutic Drug Carrier Systems, 17:101-161 (2000)).

An even more preferred activated PEG for generating the PEG-conjugated toxin peptide analogs of the present invention is a multivalent PEG having more than one activated residues. Preferred multivalent PEG moieties include, but are not limited to, those shown below:

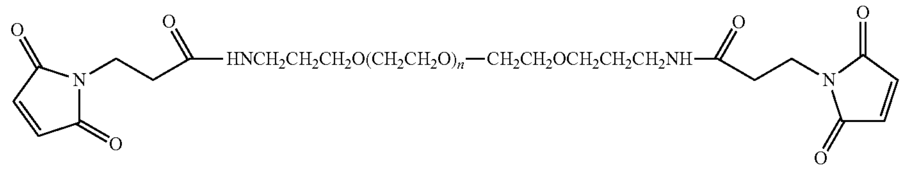

-continued
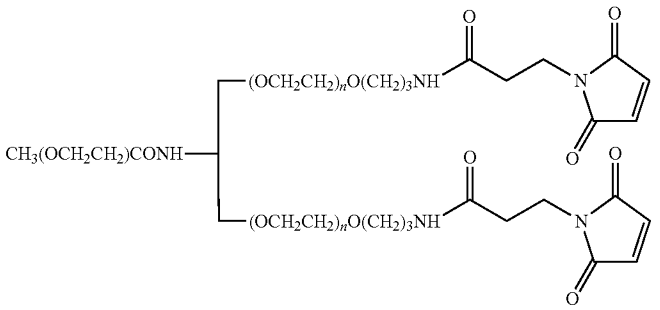
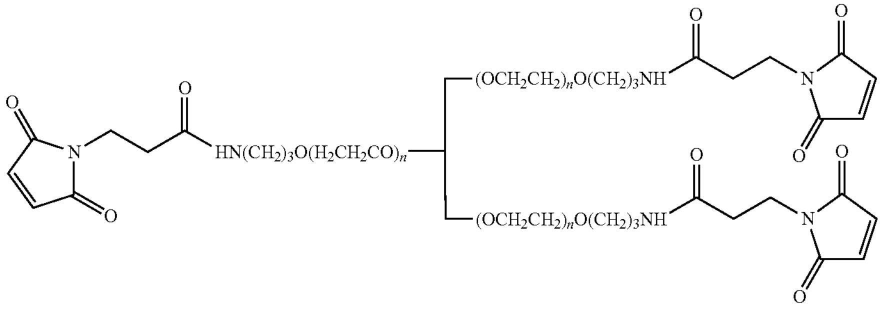
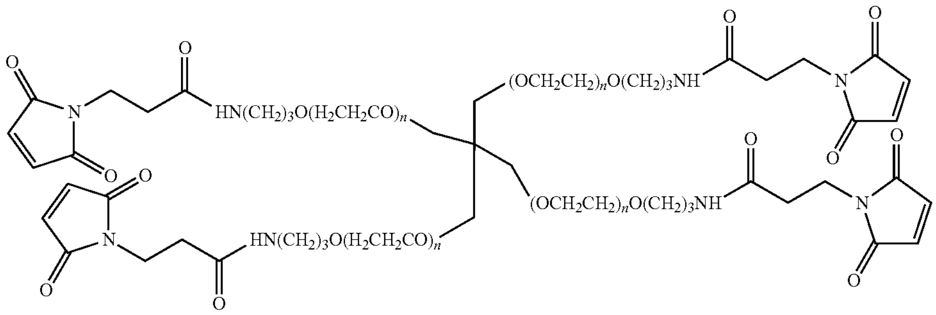
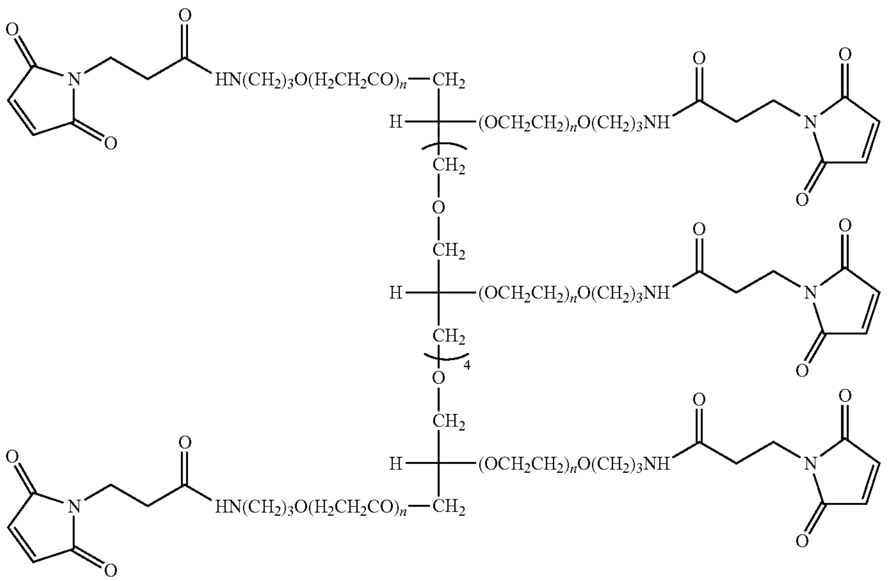

-continued

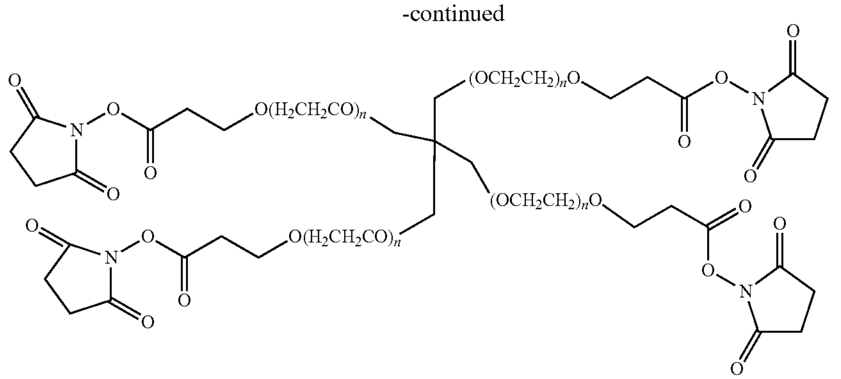

In still other embodiments of making the composition of matter, the inventive toxin peptide analog is reacted by known chemical techniques with an activated multi-branched PEG compound (PEG derivatives comprising multiple arms to give divalent, trivalent, tetravalent, octavalent constructs), such as but not limited to, pentaerythritol tetra-polyethyleneglycol ether. Functionalization and activated derivatives, such as, but not limited to, N-succinimidyloxycarbonyl)propyl, p-nitrophenyloxycarbonyl, (—$CO_2$-p-$C_6H_4NO_2$), 3-(N-maleimido)propanamido, 2-sulfanylethyl, and 3-aminopropyl. Using a 4-arm PEG derivative, four toxin peptide analogs are attached to each PEG molecule. For example, in accordance with the present invention, the toxin peptide analog can be conjugated to a polyethylene glycol (PEG) at:

(a) 1, 2, 3 or 4 amino functionalized sites of the PEG;
(b) 1, 2, 3 or 4 thiol functionalized sites of the PEG;
(c) 1, 2, 3 or 4 maleimido functionalized sites of the PEG;
(d) 1, 2, 3 or 4 N-succinimidyl functionalized sites of the PEG;
(e) 1, 2, 3 or 4 carboxyl functionalized sites of the PEG; or
(f) 1, 2, 3 or 4 p-nitrophenyloxycarbonyl functionalized sites of the PEG.

The smallest practical size of PEG is about 500 Daltons (Da), below which PEG becomes toxic. Above about 500 Da, any molecular mass for a PEG can be used as practically desired, e.g., from about 1,000 Daltons (Da) to 100,000 Da (n is 20 to 2300). The number of PEG monomers (n) is approximated from the average molecular mass using a MW=44 Da for each monomer. It is preferred that the combined molecular mass of PEG on an activated linker is suitable for pharmaceutical use. Thus, the combined molecular mass of the PEG molecule should not exceed about 100,000 Da. In some embodiments, the combined or total average molecular mass of PEG used in a PEG-conjugated toxin peptide analog of the present invention is from about 3,000 Da to 60,000 Da (total n is from 70 to 1,400), more preferably from about 10,000 Da to 40,000 Da (total n is about 230 to about 910). The most preferred combined mass for PEG is from about 20,000 Da to 30,000 Da (total n is about 450 to about 680).

It will be appreciated that "multimers" of the composition of matter can be made, since the half-life extending moiety employed for conjugation to the toxin peptide analog (with or without an intervening linker moiety) can be multivalent (e.g., bivalent, trivalent, tetravalent or a higher order valency) as to the number of amino acid residues at which the half-life extending moiety can be conjugated. In some embodiments the peptide portion of the inventive composition of matter can be multivalent (e.g., bivalent, trivalent, tetravalent or a higher order valency), and, thus, some "multimers" of the inventive composition of matter may have more that one half life extending moiety. Consequently, it is possible by the inventive method of producing a composition of matter to produce a variety of conjugated half-life extending moiety peptide structures. By way of example, a univalent half-life extending moiety and a univalent peptide will produce a 1:1 conjugate; a bivalent peptide and a univalent half-life extending moiety may form conjugates wherein the peptide conjugates bear two half-life extending moiety moieties, whereas a bivalent half-life extending moiety and a univalent peptide may produce species where two peptide entities are linked to a single half-life extending moiety; use of higher-valence half-life extending moiety can lead to the formation of clusters of peptide entities bound to a single half-life extending moiety, whereas higher-valence peptides may become encrusted with a plurality of half-life extending moiety moieties. By way of further example, if the site of conjugation of a multivalent half-life extending moiety to the toxin peptide analog is a cysteine or other aminothiol the methods disclosed by D'Amico et al. may be employed (D'Amico et al., Method of conjugating aminothiol containing molecules to vehicles, published as US 2006/0199812, which application is incorporated herein by reference in its entirety).

The peptide moieties may have more than one reactive group which will react with the activated half-life extending moiety and the possibility of forming complex structures must always be considered; when it is desired to form simple structures such as 1:1 adducts of half-life extending moiety and peptide, or to use bivalent half-life extending moiety to form peptide:half-life extending moiety:peptide adducts, it will be beneficial to use predetermined ratios of activated half-life extending moiety and peptide material, predetermined concentrations thereof and to conduct the reaction under predetermined conditions (such as duration, temperature, pH, etc.) so as to form a proportion of the described product and then to separate the described product from the other reaction products. The reaction conditions, proportions and concentrations of the reagents can be obtained by relatively simple trial-and-error experiments which are within the ability of an ordinarily skilled artisan with appropriate scaling-up as necessary. Purification and separation of the products is similarly achieved by conventional techniques well known to those skilled in the art.

Additionally, physiologically acceptable salts of the half-life extending moiety-fused or conjugated to the toxin peptide analogs of this invention are also encompassed within the composition of matter of the present invention.

The above-described half-life extending moieties and other half-life extending moieties described herein are useful, either individually or in combination, and as further described in the art, for example, in Sullivan et al., Toxin Peptide Therapeutic Agents, US2007/0071764 and Sullivan et al., Toxin Peptide Therapeutic Agents, PCT/US2007/022831, published as WO 2008/088422, which are both incorporated herein by reference in their entireties. The invention encompasses the use of any single species of pharmaceutically acceptable half-life extending moiety, such as, but not limited to, those described herein, in conjugation with the toxin peptide analog, or the use of a combination of two or more like or different half-life extending moieties.

Linkers.

A "linker moiety" as used herein refers to a biologically acceptable peptidyl or non-peptidyl organic group that is covalently bound to an amino acid residue of a toxin peptide analog or other polypeptide chain (e.g., an immunoglobulin HC or LC or immunoglobulin Fc domain) contained in the inventive composition, which linker moiety covalently joins or conjugates the toxin peptide analog or other polypeptide chain to another peptide or polypeptide chain in the composition, or to a half-life extending moiety. In some embodiments of the composition, a half-life extending moiety, as described herein, is conjugated, i.e., covalently bound directly to an amino acid residue of the toxin peptide analog itself, or optionally, to a peptidyl or non-peptidyl linker moiety (including but not limited to aromatic or aryl linkers) that is covalently bound to an amino acid residue of the toxin peptide analog. The presence of any linker moiety is optional. When present, its chemical structure is not critical, since it serves primarily as a spacer to position, join, connect, or optimize presentation or position of one functional moiety in relation to one or more other functional moieties of a molecule of the inventive composition. The presence of a linker moiety can be useful in optimizing pharmacological activity of some embodiments of the inventive composition. The linker is preferably made up of amino acids linked together by peptide bonds. The linker moiety, if present, can be independently the same or different from any other linker, or linkers, that may be present in the inventive composition. As stated above, the linker moiety, if present (whether within the primary amino acid sequence of the toxin peptide analog, or as a linker for attaching a half-life extending moiety to the toxin peptide analog), can be "peptidyl" in nature (i.e., made up of amino acids linked together by peptide bonds) and made up in length, preferably, of from 1 up to about 40 amino acid residues, more preferably, of from 1 up to about 20 amino acid residues, and most preferably of from 1 to about 10 amino acid residues. Preferably, but not necessarily, the amino acid residues in the linker are from among the twenty canonical amino acids, more preferably, cysteine, glycine, alanine, proline, asparagine, glutamine, and/or serine. Even more preferably, a peptidyl linker is made up of a majority of amino acids that are sterically unhindered, such as glycine, serine, and alanine linked by a peptide bond. It is also desirable that, if present, a peptidyl linker be selected that avoids rapid proteolytic turnover in circulation in vivo. Some of these amino acids may be glycosylated, as is well understood by those in the art. For example, a useful linker sequence constituting a sialylation site is $X_1X_2NX_4X_5G$ (SEQ ID NO:479), wherein $X_1$, $X_2$, $X_4$ and $X_5$ are each independently any amino acid residue.

In other embodiments, the 1 to 40 amino acids of the peptidyl linker moiety are selected from glycine, alanine, proline, asparagine, glutamine, and lysine. Preferably, a linker is made up of a majority of amino acids that are sterically unhindered, such as glycine and alanine. Thus, preferred linkers include polyglycines, polyserines, and polyalanines, or combinations of any of these. Some exemplary peptidyl linkers are poly$(Gly)_{1-8}$, particularly $(Gly)_3$, $(Gly)_4$ (SEQ ID NO:480), $(Gly)_5$ (SEQ ID NO:481) and $(Gly)_7$ (SEQ ID NO:482), as well as, GlySer and poly$(Gly)_4$Ser, such as "L15" (GGGGSGGGGSGGGGS; SEQ ID NO:483), poly $(Gly\text{-}Ala)_{2\text{-}4}$ and poly$(Ala)_{1\text{-}8}$. Other specific examples of peptidyl linkers include $(Gly)_5$Lys (SEQ ID NO:484), and $(Gly)_5$LysArg (SEQ ID NO:485). Other examples of useful peptidyl linkers are: Other examples of useful peptidyl linkers are:

| | |
|---|---|
| $(Gly)_3Lys(Gly)_4$; | (SEQ ID NO: 486) |
| $(Gly)_3AsnGlySer(Gly)_2$; | (SEQ ID NO: 487) |
| $(Gly)_3Cys(Gly)_4$; and | (SEQ ID NO: 488) |
| GlyProAsnGlyGly. | (SEQ ID NO: 489) |

To explain the above nomenclature, for example, $(Gly)_3$Lys $(Gly)_4$ means Gly-Gly-Gly-Lys-Gly-Gly-Gly-Gly (SEQ ID NO:490). Other combinations of Gly and Ala are also useful.

Other preferred linkers are those identified herein as "L5" (GGGGS; or "$G_4S$"; SEQ ID NO:491), "L10" (GGGGSGGGGS; SEQ ID NO:492); "L20" (GGGGSGGGGSGGGGSGGGGS; SEQ ID NO:477); "L25" (GGGGSGGGGSGGGGSGGGGSGGGGS; SEQ ID NO:493) and any linkers used in the working examples hereinafter.

In some embodiments of the compositions of this invention, which comprise a peptide linker moiety, acidic residues, for example, glutamate or aspartate residues, are placed in the amino acid sequence of the linker moiety. Examples include the following peptide linker sequences:

| | |
|---|---|
| GGEGGG; | (SEQ ID NO: 494) |
| GGEEEGGG; | (SEQ ID NO: 495) |
| GEEEG; | (SEQ ID NO: 496) |
| GEEE; | (SEQ ID NO: 497) |
| GGDGGG; | (SEQ ID NO: 498) |
| GGDDDGG; | (SEQ ID NO: 499) |
| GDDDG; | (SEQ ID NO: 500) |
| GDDD; | (SEQ ID NO: 501) |
| GGGGSDDSDEGSDGEDGGGGS; | (SEQ ID NO: 502) |
| WEWEW; | (SEQ ID NO: 503) |
| FEFEF; | (SEQ ID NO: 504) |
| EEEWWW; | (SEQ ID NO: 505) |
| EEEFFF; | (SEQ ID NO: 506) |
| WWEEEWW; or | (SEQ ID NO: 507) |
| FFEEEFF. | (SEQ ID NO: 508) |

In other embodiments, the linker constitutes a phosphorylation site, e.g., $X_1X_2YX_4X_5G$ (SEQ ID NO:509), wherein $X_1$, $X_2$, $X_4$, and $X_5$ are each independently any amino acid residue; $X_1X_2SX_4X_5G$ (SEQ ID NO:510), wherein $X_1$, $X_2$, $X_4$ and $X_5$ are each independently any amino acid residue; or $X_1X_2TX_4X_5G$ (SEQ ID NO:511), wherein $X_1$, $X_2$, $X_4$ and $X_5$ are each independently any amino acid residue.

The linkers shown here are exemplary; peptidyl linkers within the scope of this invention may be much longer and may include other residues. A peptidyl linker can contain, e.g., a cysteine, another thiol, or nucleophile for conjugation with a half-life extending moiety. In another embodiment, the linker contains a cysteine or homocysteine residue, or other 2-amino-ethanethiol or 3-amino-propanethiol moiety for conjugation to maleimide, iodoacetaamide or thioester, functionalized half-life extending moiety.

Another useful peptidyl linker is a large, flexible linker comprising a random Gly/Ser/Thr sequence, for example: GSGSATGGSGSTASSGSGSATH (SEQ ID NO:512) or HGSGSATGGSGSTASSGSGSAT (SEQ ID NO:513), that is estimated to be about the size of a 1 kDa PEG molecule. Alternatively, a useful peptidyl linker may be comprised of amino acid sequences known in the art to form rigid helical structures (e.g., Rigid linker: -AEAAAKEAAAKEAAAK-AGG-//SEQ ID NO:514). Additionally, a peptidyl linker can also comprise a non-peptidyl segment such as a 6 carbon aliphatic molecule of the formula $—CH_2—CH_2—CH_2—CH_2—CH_2—CH_2—$. The peptidyl linkers can be altered to form derivatives as described herein.

Optionally, a non-peptidyl linker moiety is also useful for conjugating the half-life extending moiety to the peptide portion of the half-life extending moiety-conjugated toxin peptide analog. For example, alkyl linkers such as $—NH—(CH_2)_s—C(O)—$, wherein s=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc. Exemplary non-peptidyl linkers are PEG linkers (e.g., shown below):

(III)

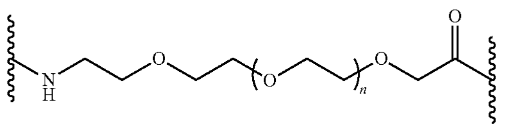

wherein n is such that the linker has a molecular weight of about 100 to about 5000 Daltons (Da), preferably about 100 to about 500 Da.

In one embodiment, the non-peptidyl linker is aryl. The linkers may be altered to form derivatives in the same manner as described herein. In addition, PEG moieties may be attached to the N-terminal amine or selected side chain amines by either reductive alkylation using PEG aldehydes or acylation using hydroxysuccinimido or carbonate esters of PEG, or by thiol conjugation.

"Aryl" is phenyl or phenyl vicinally-fused with a saturated, partially-saturated, or unsaturated 3-, 4-, or 5 membered carbon bridge, the phenyl or bridge being substituted by 0, 1, 2 or 3 substituents selected from $C_{1-8}$ alkyl, $C_{1-4}$ haloalkyl or halo. "Heteroaryl" is an unsaturated 5, 6 or 7 membered monocyclic or partially-saturated or unsaturated 6-, 7-, 8-, 9-, 10- or 11 membered bicyclic ring, wherein at least one ring is unsaturated, the monocyclic and the bicyclic rings containing 1, 2, 3 or 4 atoms selected from N, O and S, wherein the ring is substituted by 0, 1, 2 or 3 substituents selected from $C_{1-8}$ alkyl, $C_{1-4}$ haloalkyl and halo.

Non-peptide portions of the inventive composition of matter, such as non-peptidyl linkers or non-peptide half-life extending moieties can be synthesized by conventional organic chemistry reactions.

The above is merely illustrative and not an exhaustive treatment of the kinds of linkers that can optionally be employed in accordance with the present invention.

Compositions of this invention incorporating the isolated polypeptide antagonists of the voltage-gated sodium channel $Na_V1.3$ and/or $Na_V1.7$, in particular GpTx-1 and GpTx-1 toxin peptide analogs of the present invention, whether or not conjugated to a half-life extending moiety, are useful as therapeutic agents in the treatment of pain, for example in humans. Clinical genetic information, replicated independently by several groups, shows unambiguously that the product of the Nav1.7 (SCN9A) gene is a key control point for the perception of pain. In humans, loss-of-function truncation mutations of the gene lead to complete insensitivity to all forms of pain measured, whereas the human chronic pain syndromes primary erythromelalgia and paroxysmal extreme pain disorder are caused by gain-of-function mutations in $Na_V1.7$ that lead to easier or more prolonged Nav1.7 channel opening. Remarkably, no other major neurological abnormalities are present in patients carrying either truncation or gain-of-function mutations in $Na_V1.7$ (Goldberg et al., Clin Genet. 71:311-319 (2007); Cox et al., Nature 444:894-898 (2006); Ahmad et al., Hum Mol Genet. 16:2114-2121 (2007); Fertleman et al., Neurology 69:586-595 (2007)). Accordingly, a therapeutic that blocks $Na_V1.7$ can be expected to be of great utility for the treatment of pain in humans.

Specific clinical chronic pain syndromes include, but are not limited to, pain associated with, or due to, cancer, chemotherapy, osteoarthritis, fibromyalgia, primary erythromelalgia, post-herpetic neuralgia, painful diabetic neuropathy, idiopathic painful neuropathy, neuromas, paroxysmal extreme pain disorder, migraine, trigeminal neuralgia, orofacial pain, cluster or other headaches, complex regional pain syndrome (CRPS), failed back surgery syndrome, sciatica (including lower back pain), interstitial cystitis and pelvic pain, inflammation-induced pain including cellulitis, and rheumatic or joint pain. A $Na_V1.7$ inhibitor can also have great utility for treatment of acute or persistent pain, including but not limited to pain following trauma, burns, or surgery. Notably, inhibition of $Na_V1.7$ is not expected to result in the adverse effects on cognition and on the gastrointestinal system that limit the use of opioid drugs. Again unlike opioids, $Na_V1.7$ inhibitors should not produce respiratory depression, patient tolerance, or addiction. Moreover, $Na_V1.7$ expression in humans and in non-human primates is overwhelmingly in the peripheral nervous system, with little or no message or protein in the brain or spinal cord (Ahmad et al., Hum Mol Genet. 16:2114-2121, 2007). Consistent with these studies, our data show that among CNS areas from post-mortem humans examined with in situ hybridization, message RNA for $Na_V1.7$ was found only in light amounts in hypothalamic nuclei and in ventral motor areas of the spinal cord and spinal ependyma, areas with no known involvement in the pain response. By contrast, no $Na_V1.7$ was found in cerebral cortex, cerebellum, adrenal medulla, pituitary, or dorsal or deep regions of lumbar spinal cord. Strong $Na_V1.7$ expression was found in peripheral nerves including dorsal root ganglia, trigeminal ganglia, and myenteric plexes of the stomach and intestine. (See, FIG. 13A-E). This suggests that an inhibitor of $Na_V1.7$ would exert analgesic efficacy via the peripheral nervous system without a need for CNS penetrance. As peptides generally do not cross the blood-brain barrier, a peptide inhibitor thus has an advantage over small molecules with some CNS-penetrance in that a peptide should not produce common off-target side effects mediated by the brain such as dizziness, confusion, or sedation.

The clinical genetic data for $Na_V1.7$ do not address whether $Na_V1.7$ maintains its key role in pain perception in patients with damage to and subsequent remodeling of the nervous system. Such remodeling is likely a feature of many chronic pain syndromes (Woolf and Ma, Neuron 55:353-364 (2007)). For such cases, antagonism of the $Na_V1.3$ sodium channel may prove of great therapeutic benefit. Published results show up-regulation of mRNA encoding $Na_V1.3$ in sensory neurons of rats subjected to spinal nerve ligation surgery, a standard model for neuropathic pain in humans (Haim et al., J Neurosci 24:4832-4839, 2004). This implies that for some chronic pain syndromes, especially neuropathic pain, inhibition of $Na_V1.3$ in addition to $Na_V1.7$ may produce the best analgesic efficacy. Electrophysiological studies of the cell bodies of rat sensory neurons show that spinal nerve ligation causes a dramatic shift in sodium channel expression to the fast, tetrodotoxin-sensitive subtype most likely encoded by SCN9A ($Na_V1.7$) and SCN3A ($Na_V1.3$) (see, FIG. 14A-E). Again this implies that for some pain syndromes, simultaneous dual inhibition of Nav1.7 and Nav1.3 can produce the most effective suppression of pain.

Accordingly, the present invention also relates to the use of one or more of the inventive compositions of matter in the manufacture of a medicament for the treatment or prevention of a disease, disorder, or other medical condition described herein, for example, but not limited to, chronic pain, acute pain, or persistent pain, or any of the pain syndromes described herein.

Such pharmaceutical compositions can be configured for administration to a patient by a wide variety of delivery routes, e.g., an intravascular delivery route such as by injection or infusion, subcutaneous ("s.c."), intravenous ("i.v."), intramuscular, intraperitoneal ("i.p."), epidural, or intrathecal delivery routes, or for oral, enteral, pulmonary (e.g., inhalant), intranasal, transmucosal (e.g., sublingual administration), transdermal or other delivery routes and/or forms of administration known in the art. Delivery of a drug or pharmaceutical composition containing GpTx-1, or other compositions of matter of the invention, may take place via standard injectable modalities, whether self-administered or in hospital setting, or also via an implantable delivery pump to achieve the most accurate dosing and the most stable plasma exposure levels. The inventive pharmaceutical compositions may be prepared in liquid form, or may be in dried powder form, such as lyophilized form, or crystalline form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

Pharmaceutical Compositions

In General.

The present invention also provides pharmaceutical compositions comprising the inventive composition of matter and a pharmaceutically acceptable carrier. Such pharmaceutical compositions can be configured for administration to a patient by a wide variety of delivery routes, e.g., an intravascular delivery route such as by injection or infusion, subcutaneous, intramuscular, intraperitoneal, epidural, or intrathecal delivery routes, or for oral, enteral, pulmonary (e.g., inhalant), intranasal, transmucosal (e.g., sublingual administration), transdermal or other delivery routes and/or forms of administration known in the art. The inventive pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In the practice of this invention the "pharmaceutically acceptable carrier" is any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination. Such pharmaceutical compositions can include diluents of various buffer content (e.g., Tris-HCl, acetate, phosphate), pH and ionic strength; additives such as detergents and solubilizing agents (e.g., Tween® 80 detergent, Polysorbate 80), anti-oxidants (e.g., ascorbic acid, sodium metabisulfite), preservatives (e.g., thimerosal, benzyl alcohol) and bulking substances (e.g., lactose, mannitol); incorporation of the material into particulate preparations of polymeric compounds such as polylactic acid, polyglycolic acid, etc. or into liposomes. Hyaluronic acid can also be used, and this can have the effect of promoting sustained duration in the circulation. Such compositions can influence the physical state, stability, rate of in vivo release, and rate of in vivo clearance of the present proteins and derivatives. See, e.g., Remington's Pharmaceutical Sciences, 18th Ed. (1990, Mack Publishing Co., Easton, Pa. 18042) pages 1435-1712, which are herein incorporated by reference in their entirety. The compositions can be prepared in liquid form, or can be in dried powder, such as lyophilized form. Implantable sustained release formulations are also useful, as are transdermal or transmucosal formulations. Additionally (or alternatively), the present invention provides compositions for use in any of the various slow or sustained release formulations or microparticle formulations known to the skilled artisan, for example, sustained release microparticle formulations, which can be administered via pulmonary, intranasal, or subcutaneous delivery routes. (See, e.g., Murthy et al., Injectable compositions for the controlled delivery of pharmacologically active compound, U.S. Pat. No. 6,887,487; Manning et al., Solubilization of pharmaceutical substances in an organic solvent and preparation of pharmaceutical powders using the same, U.S. Pat. Nos. 5,770,559 and 5,981,474; Lieberman et al., Lipophilic complexes of pharmacologically active inorganic mineral acid esters of organic compounds, U.S. Pat. No. 5,002,936; Gen, Formative agent of protein complex, US 2002/0119946 A1; Goldenberg et al., Sustained release formulations, WO 2005/105057 A1).

One can dilute the inventive compositions or increase the volume of the pharmaceutical compositions of the invention with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride. Some commercially available diluents are Fast-Flo, Emdex, STA-Rx 1500, Emcompress and Avicell.

A variety of conventional thickeners are useful in creams, ointments, suppository and gel configurations of the pharmaceutical composition, such as, but not limited to, alginate, xanthan gum, or petrolatum, may also be employed in such configurations of the pharmaceutical composition of the present invention. A permeation or penetration enhancer, such as polyethylene glycol monolaurate, dimethyl sulfoxide, N-vinyl-2-pyrrolidone, N-(2-hydroxyethyl)-pyrrolidone, or 3-hydroxy-N-methyl-2-pyrrolidone can also be employed. Useful techniques for producing hydrogel matrices are known. (E.g., Feijen, Biodegradable hydrogel matrices for the controlled release of pharmacologically active agents, U.S. Pat. No. 4,925,677; Shah et al., Biodegradable pH/thermosensitive hydrogels for sustained delivery of biologically active agents, WO 00/38651 A1). Such biodegradable gel matrices can be formed, for example, by crosslinking a proteinaceous component and a polysaccharide or mucopolysaccharide component, then loading with the inventive composition of matter to be delivered.

Liquid pharmaceutical compositions of the present invention that are sterile solutions or suspensions can be administered to a patient by injection, for example, intramuscularly, intrathecally, epidurally, intravascularly (e.g., intravenously or intraarterially), intraperitoneally or subcutaneously. (See, e.g., Goldenberg et al., Suspensions for the sustained release of proteins, U.S. Pat. No. 6,245,740 and WO 00/38652 A1). Sterile solutions can also be administered by intravenous infusion. The inventive composition can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also useful embodiments of the inventive pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, Biodegradable, implantable drug delivery device, and process for preparing and using same, U.S. Pat. No. 4,351,337). Other techniques for making implants for delivery of drugs are also known and useful in accordance with the present invention.

In powder forms, the pharmaceutically acceptable carrier is a finely divided solid, which is in admixture with finely divided active ingredient(s), including the inventive composition. For example, in some embodiments, a powder form is useful when the pharmaceutical composition is configured as an inhalant. (See, e.g., Zeng et al., Method of preparing dry powder inhalation compositions, WO 2004/017918; Trunk et al., Salts of the CGRP antagonist BIBN4096 and inhalable powdered medicaments containing them, U.S. Pat. No. 6,900, 317).

One can dilute or increase the volume of the compound of the invention with an inert material. These diluents could include carbohydrates, especially mannitol, α-lactose, anhydrous lactose, cellulose, sucrose, modified dextrans and starch. Certain inorganic salts can also be used as fillers including calcium triphosphate, magnesium carbonate and sodium chloride. Some commercially available diluents are Fast-Flo™, Emdex™, STA-Rx™ 1500, Emcompress™ and Avicell™.

Disintegrants can be included in the formulation of the pharmaceutical composition into a solid dosage form. Materials used as disintegrants include but are not limited to starch including the commercial disintegrant based on starch, Explotab™Sodium starch glycolate, Amberlite™, sodium carboxymethylcellulose, ultramylopectin, sodium alginate, gelatin, orange peel, acid carboxymethyl cellulose, natural sponge and bentonite can all be used. Insoluble cationic exchange resin is another form of disintegrant. Powdered gums can be used as disintegrants and as binders and these can include powdered gums such as agar, Karaya or tragacanth. Alginic acid and its sodium salt are also useful as disintegrants.

Binders can be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic. An antifrictional agent can be included in the formulation of the therapeutic to prevent sticking during the formulation process. Lubricants can be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants can also be used such as sodium lauryl sulfate, magnesium lauryl sulfate, polyethylene glycol of various molecular weights, Carbowax 4000 and 6000.

Glidants that might improve the flow properties of the drug during formulation and to aid rearrangement during compression might be added. The glidants can include starch, talc, pyrogenic silica and hydrated silicoaluminate.

To aid dissolution of the compound of this invention into the aqueous environment a surfactant might be added as a wetting agent. Surfactants can include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the protein or derivative either alone or as a mixture in different ratios.

Oral Dosage Forms.

Also useful are oral dosage forms of the inventive compositions. If necessary, the composition can be chemically modified so that oral delivery is efficacious. Generally, the chemical modification contemplated is the attachment of at least one moiety to the molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached half-life extending moieties in this invention can also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis (1981), *Soluble Polymer-Enzyme Adducts, Enzymes as Drugs* (Hocenberg and Roberts, eds.), Wiley-Interscience, New York, N.Y., pp 367-83; Newmark, et al. (1982), *J. Appl. Biochem.* 4:185-9. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl]amino) caprylate (SNAC), as a carrier to enhance absorption of the therapeutic compounds of this invention. The clinical efficacy of a heparin formulation using SNAC has been demonstrated in a Phase II trial conducted by Emisphere Technologies. See U.S. Pat. No. 5,792,451, "Oral drug delivery composition and methods."

In one embodiment, the pharmaceutically acceptable carrier can be a liquid and the pharmaceutical composition is prepared in the form of a solution, suspension, emulsion, syrup, elixir or pressurized composition. The active ingredient(s) (e.g., the inventive composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators. Additives can also be included in the formulation to enhance uptake of the inventive composition. Additives potentially having this property are for instance the fatty acids oleic acid, linoleic acid and linolenic acid.

Useful are oral solid dosage forms, which are described generally in *Remington's Pharmaceutical Sciences* (1990), supra, in Chapter 89, which is hereby incorporated by reference in its entirety. Solid dosage forms include tablets, capsules, pills, troches or lozenges, cachets or pellets. Also, liposomal or proteinoid encapsulation can be used to formulate the present compositions (as, for example, proteinoid microspheres reported in U.S. Pat. No. 4,925,673). Liposomal encapsulation can be used and the liposomes can be derivatized with various polymers (e.g., U.S. Pat. No. 5,013,556). A description of possible solid dosage forms for the therapeutic is given in Marshall, K., *Modern Pharmaceutics* (1979), edited by G. S. Banker and C. T. Rhodes, in Chapter 10, which is hereby incorporated by reference in its entirety. In general, the formulation will include the inventive compound, and inert ingredients that allow for protection against the stomach environment, and release of the biologically active material in the intestine.

The composition of this invention can be included in the formulation as fine multiparticulates in the form of granules or pellets of particle size about 1 mm. The formulation of the material for capsule administration could also be as a powder, lightly compressed plugs or even as tablets. The therapeutic could be prepared by compression.

Colorants and flavoring agents can all be included. For example, the protein (or derivative) can be formulated (such as by liposome or microsphere encapsulation) and then further contained within an edible product, such as a refrigerated beverage containing colorants and flavoring agents.

In tablet form, the active ingredient(s) are mixed with a pharmaceutically acceptable carrier having the necessary compression properties in suitable proportions and compacted in the shape and size desired.

The powders and tablets preferably contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

Controlled release formulation can be desirable. The composition of this invention can be incorporated into an inert matrix that permits release by either diffusion or leaching mechanisms e.g., gums. Slowly degenerating matrices can also be incorporated into the formulation, e.g., alginates, polysaccharides. Another form of a controlled release of the compositions of this invention is by a method based on the Oros™ therapeutic system (Alza Corp.), i.e., the drug is enclosed in a semipermeable membrane which allows water to enter and push drug out through a single small opening due to osmotic effects. Some enteric coatings also have a delayed release effect.

Other coatings can be used for the formulation. These include a variety of sugars that could be applied in a coating pan. The therapeutic agent could also be given in a film-coated tablet and the materials used in this instance are divided into 2 groups. The first are the nonenteric materials and include methylcellulose, ethyl cellulose, hydroxyethyl cellulose, methylhydroxy-ethyl cellulose, hydroxypropyl cellulose, hydroxypropyl-methyl cellulose, sodium carboxymethyl cellulose, providone and the polyethylene glycols. The second group consists of the enteric materials that are commonly esters of phthalic acid.

A mix of materials might be used to provide the optimum film coating. Film coating can be carried out in a pan coater or in a fluidized bed or by compression coating.

Pulmonary Delivery Forms.

Pulmonary delivery of the inventive compositions is also useful. The protein (or derivative) is delivered to the lungs of a mammal while inhaling and traverses across the lung epithelial lining to the blood stream. (Other reports of this include Adjei et al., *Pharma. Res.* (1990) 7: 565-9; Adjei et al. (1990), *Internatl. J. Pharmaceutics* 63: 135-44 (leuprolide acetate); Braquet et al. (1989), *J. Cardiovasc. Pharmacol.* 13 (suppl. 5): s.143-146 (endothelin-1); Hubbard et al. (1989), *Annals Int. Med.* 3: 206-12 (α1-antitrypsin); Smith et al. (1989), *J. Clin. Invest.* 84: 1145-6 (α1-proteinase); Oswein et al. (March 1990), "Aerosolization of Proteins," *Proc. Symp. Resp. Drug Delivery II*, Keystone, Colo. (recombinant human growth hormone); Debs et al. (1988), *J. Immunol.* 140: 3482-8 (interferon-γ and tumor necrosis factor α) and Platz et al., U.S. Pat. No. 5,284,656 (granulocyte colony stimulating factor).

Useful in the practice of this invention are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, North Carolina; and the Spinhaler powder inhaler, manufactured by Fisons Corp., Bedford, Mass. (See, e.g., Helgesson et al., Inhalation device, U.S. Pat. No. 6,892,728; McDerment et al., Dry powder inhaler, WO 02/11801 A1; Ohki et al., Inhalant medicator, U.S. Pat. No. 6,273,086). All such devices require the use of formulations suitable for the dispensing of the inventive compound. Typically, each formulation is specific to the type of device employed and can involve the use of an appropriate propellant material, in addition to diluents, adjuvants and/or carriers useful in therapy.

The inventive compound should most advantageously be prepared in particulate form with an average particle size of less than 10 μm (or microns), most preferably 0.5 to 5 μm, for most effective delivery to the distal lung.

Pharmaceutically acceptable excipients include carbohydrates such as trehalose, mannitol, xylitol, sucrose, lactose, and sorbitol. Other ingredients for use in formulations can include DPPC, DOPE, DSPC and DOPC. Natural or synthetic surfactants can be used. PEG can be used (even apart from its use in derivatizing the protein or analog). Dextrans, such as cyclodextran, can be used. Bile salts and other related enhancers can be used. Cellulose and cellulose derivatives can be used. Amino acids can be used, such as use in a buffer formulation.

Also, the use of liposomes, microcapsules or microspheres, inclusion complexes, or other types of carriers is contemplated.

Formulations suitable for use with a nebulizer, either jet or ultrasonic, will typically comprise the inventive compound dissolved in water at a concentration of about 0.1 to 25 mg of biologically active protein per mL of solution. The formulation can also include a buffer and a simple sugar (e.g., for protein stabilization and regulation of osmotic pressure). The nebulizer formulation can also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant can be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid can also be useful as a surfactant. (See, e.g., Bäckström et al., Aerosol drug formulations containing hydrofluoroalkanes and alkyl saccharides, U.S. Pat. No. 6,932,962).

Formulations for dispensing from a powder inhaler device will comprise a finely divided dry powder containing the inventive compound and can also include a bulking agent, such as lactose, sorbitol, sucrose, mannitol, trehalose, or xylitol in amounts which facilitate dispersal of the powder from the device, e.g., 50 to 90% by weight of the formulation.

Nasal Delivery Forms.

In accordance with the present invention, intranasal delivery of the inventive composition of matter and/or pharmaceutical compositions is also useful, which allows passage thereof to the blood stream directly after administration to the inside of the nose, without the necessity for deposition of the product in the lung. Formulations suitable for intransal administration include those with dextran or cyclodextran, and intranasal delivery devices are known. (See, e.g, Freezer, Inhaler, U.S. Pat. No. 4,083,368).

Transdermal and Transmucosal (e.g., Buccal) Delivery Forms).

In some embodiments, the inventive composition is configured as a part of a pharmaceutically acceptable transdermal or transmucosal patch or a troche. Transdermal patch drug delivery systems, for example, matrix type transdermal patches, are known and useful for practicing some embodiments of the present pharmaceutical compositions. (E.g., Chien et al., Transdermal estrogen/progestin dosage unit, system and process, U.S. Pat. Nos. 4,906,169 and 5,023,084; Cleary et al., Diffusion matrix for transdermal drug administration and transdermal drug delivery devices including same, U.S. Pat. No. 4,911,916; Teillaud et al., EVA-based transdermal matrix system for the administration of an estrogen and/or a progestogen, U.S. Pat. No. 5,605,702; Venkateshwaran et al., Transdermal drug delivery matrix for coadministering estradiol and another steroid, U.S. Pat. No. 5,783,208; Ebert et al., Methods for providing testosterone and optionally estrogen replacement therapy to women, U.S. Pat. No. 5,460,820). A variety of pharmaceutically acceptable systems for transmucosal delivery of therapeutic agents are also known in the art and are compatible with the practice of the present invention. (E.g., Heiber et al., Transmucosal delivery of macromolecular drugs, U.S. Pat. Nos. 5,346,701 and 5,516,523; Longenecker et al., Transmembrane formulations for drug administration, U.S. Pat. No. 4,994,439).

Buccal delivery of the inventive compositions is also useful. Buccal delivery formulations are known in the art for use with peptides. For example, known tablet or patch systems configured for drug delivery through the oral mucosa (e.g., sublingual mucosa), include some embodiments that comprise an inner layer containing the drug, a permeation enhancer, such as a bile salt or fusidate, and a hydrophilic polymer, such as hydroxypropyl cellulose, hydroxypropyl methylcellulose, hydroxyethyl cellulose, dextran, pectin, polyvinyl pyrrolidone, starch, gelatin, or any number of other polymers known to be useful for this purpose. This inner layer can have one surface adapted to contact and adhere to the moist mucosal tissue of the oral cavity and can have an opposing surface adhering to an overlying non-adhesive inert layer. Optionally, such a transmucosal delivery system can be in the form of a bilayer tablet, in which the inner layer also contains additional binding agents, flavoring agents, or fillers. Some useful systems employ a non-ionic detergent along with a permeation enhancer. Transmucosal delivery devices may be in free form, such as a cream, gel, or ointment, or may comprise a determinate form such as a tablet, patch or troche. For example, delivery of the inventive composition can be via a transmucosal delivery system comprising a laminated composite of, for example, an adhesive layer, a backing layer, a permeable membrane defining a reservoir containing the inventive composition, a peel seal disc underlying the membrane, one or more heat seals, and a removable release liner. (E.g., Ebert et al., Transdermal delivery system with adhesive overlay and peel seal disc, U.S. Pat. No. 5,662,925; Chang et al., Device for administering an active agent to the skin or mucosa, U.S. Pat. Nos. 4,849,224 and 4,983,395). These examples are merely illustrative of available transmucosal drug delivery technology and are not limiting of the present invention.

Dosages.

The dosage regimen involved in a method for treating the above-described conditions will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1-1000 micrograms of the inventive compound per kilogram of body weight, preferably 0.1-150 micrograms per kilogram.

By way of further illustration, the following numbered embodiments are encompassed by the present invention:

1. A composition of matter comprising an isolated polypeptide comprising the amino acid sequence of the formula:

SEQ ID NO: 475

$X_{aa}^{1}X_{aa}^{2}X_{aa}^{3}X_{aa}^{4}X_{aa}^{5}X_{aa}^{6}X_{aa}^{7}X_{aa}^{8}X_{aa}^{9}X_{aa}^{10}X_{aa}^{11}$ $X_{aa}^{12}X_{aa}^{13}X_{aa}^{14}Asp^{15}X_{aa}^{16}X_{aa}^{17}$ $X_{aa}^{18}X_{aa}^{19}X_{aa}^{20}X_{aa}^{21}X_{aa}^{22}X_{aa}^{23}X_{aa}^{24}X_{aa}^{25}X_{aa}^{26}$ $X_{aa}^{27}X_{aa}^{28}X_{aa}^{29}X_{aa}^{30}X_{aa}^{31}Lys^{32}X_{aa}^{33}$ $X_{aa}^{34}X_{aa}^{35}X_{aa}^{36}X_{aa}^{37}X_{aa}^{38}$// or a pharmaceutically acceptable salt thereof, wherein:

$X_{aa}^{1}X_{aa}^{2}$ is absent; or $X_{aa}^{1}$ is any amino acid residue and $X_{aa}^{2}$ is any amino acid residue; or $X_{aa}^{1}$ is absent and $X_{aa}^{2}$ is any amino acid residue;

$X_{aa}^{3}$ is Cys, if $X_{aa}^{18}$ is Cys; or $X_{aa}$ is SeCys, if $X_{aa}^{18}$ is SeCys; or $X_{aa}$ is an alkyl amino acid residue, if $X_{aa}^{18}$ is an alkyl amino acid residue;

$X_{aa}^{4}$ is an acidic, hydrophobic, basic, or neutral hydrophilic amino acid residue;

$X_{aa}^{5}$ is a Gly, Ala, hydrophobic, or basic amino acid residue;

$X_{aa}^{6}$ is a Gly, Ala, 2-Abu, Nle, Nva, or hydrophobic amino acid residue;

$X_{aa}^{7}$ is a Gly, Ala, aromatic, or hydrophobic amino acid residue;

$X_{aa}^{8}$ is a basic, acidic, or neutral hydrophilic amino acid residue, or an Ala residue;

$X_{aa}^{9}$ is a basic or neutral hydrophilic amino acid residue;

$X_{aa}^{10}$ is Cys if $X_{aa}^{24}$ is Cys; or $X_{aa}^{10}$ is SeCys if $X_{aa}^{24}$ is SeCys;

$X_{aa}^{11}$ is any amino acid residue;

$X_{aa}^{12}$ is a Pro, acidic, neutral, or hydrophobic amino acid residue;

$X_{aa}^{13}$ is any amino acid residue;

$X_{aa}^{14}$ is any amino acid residue;

$X_{aa}^{16}$ is a basic, neutral hydrophilic, or acidic amino acid residue, or an Ala residue;

$X_{aa}^{17}$ is a Cys if $X_{aa}^{31}$ is Cys; or $X_{aa}^{17}$ is a SeCys if $X_{aa}^{31}$ is SeCys;

$X_{aa}^{18}$ is a Cys, SeCys, or an alkyl amino acid residue;

$X_{aa}^{19}$ is any amino acid residue;

$X_{aa}^{20}$ is a Pro, Gly, basic, or neutral hydrophilic residue;

$X_{aa}^{21}$ is a basic, hydrophobic, or neutral hydrophilic amino acid residue;

$X_{aa}^{22}$ is a hydrophobic or basic amino acid residue;

$X_{aa}^{23}$ is a hydrophobic, basic, or neutral hydrophilic amino acid residue;

$X_{aa}^{24}$ is a Cys or SeCys residue;

$X_{aa}^{25}$ is a Ser, Ala, or a neutral hydrophilic amino acid residue;

$X_{aa}^{26}$ is an Ala, acidic, basic, or neutral hydrophilic amino acid residue;

$X_{aa}^{27}$ is an acidic, basic, neutral hydrophilic or hydrophobic residue;

$X_{aa}^{28}$ is an aromatic or basic amino acid residue;

$X_{aa}^{29}$ is an acidic, basic, or neutral hydrophilic amino acid residue;

$X_{aa}^{30}$ is a Trp, 5-bromoTrp, 6-bromoTrp, 5-chloroTrp, 6-chloroTrp, 1-Nal, 2-Nal, or thioTrp residue;

$X_{aa}^{31}$ is a Cys or SeCys;

$X_{aa}^{33}$ is a hydrophobic or aromatic amino acid residue;

$X_{aa}^{34}$ is any amino acid residue;

$X_{aa}^{35}$ is a hydrophobic amino acid residue;

each of $X_{aa}^{36}$, $X_{aa}^{37}$, and $X_{aa}^{38}$ is independently absent or is independently a neutral, basic, or hydrophobic amino acid residue;

and wherein:

if $X_{aa}^{3}$ and $X_{aa}^{18}$ are both Cys residues, there is a disulfide bond between residue $X_{aa}^{3}$ and residue $X_{aa}^{18}$; or if $X_{aa}^{3}$ and $X_{aa}^{18}$ are both SeCys residues, there is a diselenide bond between residue $X_{aa}^{3}$ and residue $X_{aa}^{18}$;

if $X_{aa}^{10}$ and $X_{aa}^{24}$ are both Cys residues, there is a disulfide bond between residue $X_{aa}^{10}$ and residue $X_{aa}^{24}$; or if $X_{aa}^{10}$ and $X_{aa}^{24}$ are both SeCys residues, there is a diselenide bond between residue $X_{aa}^{10}$ and residue $X_{aa}^{24}$;

if $X_{aa}^{17}$ and $X_{aa}^{31}$ are both Cys residues, there is a disulfide bond between residue $X_{aa}^{17}$ and residue $X_{aa}^{31}$; or if $X_{aa}^{17}$ and $X_{aa}^{31}$ are both SeCys residues, there is a diselenide bond between residue $X_{aa}^{17}$ and residue $X_{aa}^{1}$;

the amino-terminal residue is optionally acetylated, biotinylated, or 4-pentynoylated, or PEGylated; and the carboxy-terminal residue is optionally amidated.

2. The composition of matter of Embodiment 1 wherein $X_{aa}^{4}$ is selected from Ala, Glu, Asp, Phe, Pro, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, phosphoserine, phosphotyrosine, gamma-carboxyglutamic acid, and Cit residues.

3. The composition of matter of Embodiments 1-2, wherein $X_{aa}^{5}$ is selected from Ala, Phe, Ile, Leu, Met, Val, Trp, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues.

4. The composition of matter of Embodiments 1-3, wherein $X_{aa}^{6}$ is selected from Ala, Gly, 2-Abu, Phe, Ile, Leu, Met, Val, Trp, Tyr, proline, thiaproline, methionine, glycine, norleucine, norvaline, 1-Nal, 2-Nal, 1'NMe-Trp, cyclopentylglycine (Cpg), phenylglycine, N-methylleucine, N-methylphenylalanine, N-methylvaline, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues.

5. The composition of matter of Embodiments 1-4, wherein $X_{aa}^{1}$ is selected from Gly, Ala, Phe, Ile, Leu, Met, Val, Trp, Tyr, norleucine, norvaline, Pro, 2-pyridinylalanine, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues.

6. The composition of matter of Embodiments 1-5, wherein $X_{aa}^{8}$ is selected from Ala, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Ser, Thr, Asn, Gln, Cit, Asp, phosphoserine, phosphotyrosine, gamma-carboxyglutamic acid, and Glu residues.

7. The composition of matter of Embodiments 1-6, wherein $X_{aa}^{9}$ is selected from Ala, Pro, Met, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues.

8. The composition of matter of Embodiments 1-7, wherein $X_{aa}^{11}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

9. The composition of matter of Embodiments 1-8, wherein $X_{aa}^{12}$ is selected from alanine, valine, leucine, isoleucine, proline, serine, threonine, aspartic acid, glutamatic acid, glycine, norleucine, norvaline, 1-Nal, 2-Nal, 1'NMe-Trp, Cha, and 4-phenyl-phenylalanine (Bip), cyclohexylglycine (Chg), cyclohexylalanine (Cha), asparagine, glutamine, methionine, hydroxyproline, phenylalanine, tryptophan, and tyrosine.

10. The composition of matter of Embodiments 1-9, wherein $X_{aa}^{13}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

11. The composition of matter of Embodiments 1-10, wherein $X_{aa}^{14}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

12. The composition of matter of Embodiments 1-11, wherein $X_{aa}^{16}$ is selected from Ala, Pro, Met, Arg, Lys, His, Pra, Atz, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, Cit, Asp, phosphoserine, phosphotyrosine, gamma-carboxyglutamic acid, and Glu residues.

13. The composition of matter of Embodiments 1-12, wherein $X_{aa}^{19}$ is selected from Ala, Asp, Glu, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

14. The composition of matter of Embodiments 1-13, wherein $X_{aa}^{20}$ is selected from Ala, Gly, Pro, Met, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues.

15. The composition of matter of Embodiments 1-14, wherein $X_{aa}^{21}$ is selected from Ala, Phe, Pro, Ile, Leu, Met, Val, Tip, Tyr, Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues.

16. The composition of matter of Embodiments 1-15, wherein $X_{aa}^{22}$ is selected from Ala, Phe, Ile, Leu, Met, Val, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues.

17. The composition of matter of Embodiments 1-16, wherein $X_{aa}^{23}$ is selected from Ala, Phe, Pro, Ile, Leu, Met, Val, Trp, Tyr, Arg, Lys, His, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues.

18. The composition of matter of Embodiments 1-17, wherein $X_{aa}^{25}$ is selected from Ala, Gly Pro, Met, Gln, Asn, Ser, Thr, and Cit residues.

19. The composition of matter of Embodiments 1-18, wherein $X_{aa}^{26}$ is selected from Ala, Pro, Met, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, Glu, Asp, phosphoserine, phosphotyrosine, gamma-carboxyglutamic acid, Gln, Asn, Ser, Thr, and Cit residues.

20. The composition of matter of Embodiments 1-19, wherein $X_{aa}^{27}$ is selected from Thr, Leu, Ile, Val, Ser, Met, Gln, Asn, Phe, Tyr, Trp, norleucine, norvaline, 1-Nal, 2-Nal, cyclohexylglycine (Chg), cyclohexylalanine (Cha), 4-phenyl-phenylalanine (Bip), Arg, Lys, His, homolysine, ornithine, arginine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Asp, Glu, phosphoserine, phosphotyrosine, gamma-carboxyglutamic acid, and Gly residues.

21. The composition of matter of Embodiments 1-20, wherein $X_{aa}^{28}$ is selected from Phe, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, 1-Nal, 2-Nal, 2-pyridyl-alanine, 3-pyridyl-alanine, 4-pyridyl-alanine, 4-piperidinyl-alanine, and 4-phenyl-phenylalanine (Bip) residues.

22. The composition of matter of Embodiments 1-21, wherein $X_{aa}^{29}$ is selected from Ala, Asp, Glu, phosphoserine, phosphotyrosine, gamma-carboxyglutamic acid, Phe, Gly, His, Lys, Asn, Pro, Gln, Arg, Ser, Thr, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, and Dab residues.

23. The composition of matter of Embodiments 1-22, wherein $X_{aa}^{33}$ is selected from Phe, Ile, Leu, Met, Val, Trp, Tyr, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, 2-pyridyl-alanine, 3-pyridyl-alanine, 4-pyridyl-alanine, 4-piperidinyl-alanine, and 4-phenyl-phenylalanine (Bip) residues.

24. The composition of matter of Embodiments 1-23, wherein $X_{aa}^{34}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, 2-pyridyl-alanine, 3-pyridyl-alanine, 4-carboxy-phenylalanine, and 4-phenyl-phenylalanine (Bip) residues.

25. The composition of matter of Embodiments 1-24, wherein $X_{aa}^{35}$ is selected from Phe, Ile, Leu, Met, Val, Trp, Tyr, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues.

26. The composition of matter of Embodiments 1-25, wherein each of $X_{aa}^{36}$, $X_{aa}^{37}$, and $X_{aa}^{38}$ is independently absent or is independently selected from Ala, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

27. The composition of matter of Embodiments 1-26, wherein $X_{aa}^{3}$ and $X_{aa}^{18}$ are alkyl residues.

28. The composition of matter of Embodiment 27, wherein $X_{aa}^{3}$ and $X_{aa}^{18}$ are, independently, Ala or 2-Abu residues.

29. The composition of matter of Embodiments 1-28, wherein the carboxy-terminal residue is amidated.

30. The composition of matter of Embodiments 1-29, wherein the isolated polypeptide comprises the amino acid sequence of the formula:

SEQ ID NO: 476

$$X_{aa}^{1}X_{aa}^{2}Cys^{3}X_{aa}^{4}X_{aa}^{5}Ala^{6}X_{aa}^{7}X_{aa}^{8}X_{aa}^{9}$$

$$Cys^{10}X_{aa}^{11}X_{aa}^{12}X_{aa}^{13}X_{aa}^{14}Asp^{15}$$

$$X_{aa}^{16}Cys^{17}Cys^{18}X_{aa}^{19}X_{aa}^{20}X_{aa}^{21}X_{aa}^{22}$$

$$X_{aa}^{23}Cys^{24}X_{aa}^{25}X_{aa}^{26}X_{aa}^{27}X_{aa}^{28}X_{aa}^{29}X_{aa}^{30}$$

$$Cys^{31}Lys^{32}X_{aa}^{33}X_{aa}^{34}X_{aa}^{35}X_{aa}^{36}X_{aa}^{37}X_{aa}^{38}//.$$

31. The composition of matter of Embodiments 1-29, wherein $X_{aa}^{6}$ is Ala.

32. The composition of matter of Embodiment 31, wherein $X_{aa}^{27}$ is Glu.

33. The composition of matter of Embodiments 31-32, wherein $X_{aa}^{29}$ is Asp, Glu, or Gln.

34. The composition of matter of Embodiment 31, comprising an amino acid sequence selected from SEQ ID NOS: 22, 252-263, 419-439, 518-521, 524, 525, 562-580, 602, 691, 692, 696-703, 715, 721-735, 737-749, 756, 757, 761, 762, 764-771, 787-796, 798, 800, 802, 803, 809-812, 1028, 1030-1040, 1043-1047, 1062-1065, and 1068-1070.

35. The composition of matter of Embodiment 31, comprising an amino acid sequence selected from SEQ ID NOS: 1082, 1096, 1110, 1124, 1135, 1146, 1157, 1165, 1173, 1181, 1192, 1203, 1214, 1222, 1230, 1238, 1249, 1260, 1271, 1279, 1287, 1295, 1306, 1317, 1328, 1336, 1344, 1352, 1360, 1368, 1376, 1384, 1392, 1400, 1408, 1416, 1424, 1432, 1440, 1448, 1456, 1464, 1472, 1480, 1488, 1496, 1504, 1512, 1520, 1528, 1536, 1544, 1552, 1560, 1568, 1576, 1584, 1592, 1600, 1608, 1616, 1624, 1632, 1640, 1658, 1672, 1686, 1700, 1711, 1722, 1733, 1741, 1749, 1757, 1768, 1779, 1790, 1798, 1806, 1814, 1825, 1836, 1847, 1855, 1863, 1871, 1882, 1893, 1904, 1912, 1920, 1928, 1936, 1944, 1952, 1960, 1968, 1976, 1984, 1992, 2000, 2008, 2016, 2024, 2032, 2040, 2048, 2056, 2064, 2072, 2080, 2088, 2096, 2104, 2112, 2120, 2128, 2136, 2144, 2152, 2160, 2168, 2176, 2184, 2192, 2200, 2208, 2216, 2234, 2248, 2262, 2276, 2287, 2298, 2309, 2317, 2325, 2333, 2344, 2355, 2366, 2374, 2382, 2390, 2401, 2412, 2423, 2431, 2439, 2447, 2458, 2469, 2480, 2488, 2496, 2504, 2512, 2520, 2528, 2536, 2544, 2552, 2560, 2568, 2576, 2584, 2592, 2600, 2608, 2616, 2624, 2632, 2640, 2648, 2656, 2664, 2672, 2680, 2688, 2696, 2704, 2712, 2720, 2728, 2736, 2744, 2752, 2760, 2768, 2776, 2784, 2792, 2808, 2822, 2833, 2844, 2855, 2863, 2871, 2879, 2890, 2901, 2912, 2920, 2928, 2936, 2944, 2952, 2960, 2968, 2976, 2984, 2992, 3000, 3008, 3016, 3024, 3032, 3040, 3048, 3056, 3064, 3072, and 3080.

36. The composition of matter of Embodiment 31, comprising an amino acid sequence selected from SEQ ID NOS: 597-601 and 813-1027.

37. The composition of matter of Embodiments 1-29, wherein $X_{aa}^{6}$ is Gly.

38. The composition of matter of Embodiment 37, wherein $X_{aa}^{27}$ is Glu.

39. The composition of matter of Embodiments 37-38, wherein $X_{aa}^{29}$ is Asp, Glu, or Gln.

40. The composition of matter of Embodiment 37, comprising an amino acid sequence selected from SEQ ID NOS: 265, 751, 752, 754, 755, 1081, 1095, 1109, 1123, 1134, 1145, 1156, 1164, 1172, 1180, 1191, 1202, 1213, 1221, 1229, 1237, 1248, 1259, 1270, 1278, 1286, 1294, 1305, 1316, 1327, 1335, 1343, 1351, 1359, 1367, 1375, 1383, 1391, 1399, 1407, 1415, 1423, 1431, 1439, 1447, 1455, 1463, 1471, 1479, 1487, 1495, 1503, 1511, 1519, 1527, 1535, 1543, 1551, 1559, 1567, 1575, 1583, 1591, 1599, 1607, 1615, 1623, 1631, 1639, 1657, 1671, 1685, 1699, 1710, 1721, 1732, 1740, 1748, 1756, 1767, 1778, 1789, 1797, 1805, 1813, 1824, 1835, 1846, 1854, 1862, 1870, 1881, 1892, 1903, 1911, 1919, 1927, 1935, 1943, 1951, 1959, 1967, 1975, 1983, 1991, 1999, 2007, 2015, 2023, 2031, 2039, 2047, 2055, 2063, 2071, 2079, 2087, 2095, 2103, 2111, 2119, 2127, 2135, 2143, 2151, 2159, 2167, 2175, 2183, 2191, 2199, 2207, 2215, 2233, 2247, 2261, 2275, 2286, 2297, 2308, 2316, 2324, 2332, 2343, 2354, 2365, 2373, 2381, 2389, 2400, 2411, 2422, 2430, 2438, 2446, 2457, 2468, 2479, 2487, 2495, 2503, 2511, 2519, 2527, 2535, 2543, 2551, 2559, 2567, 2575, 2583, 2591, 2599, 2607, 2615, 2623, 2631, 2639, 2647, 2655, 2663, 2671, 2679, 2687, 2695, 2703, 2711, 2719, 2727, 2735, 2743, 2751, 2759, 2767, 2775, 2783, 2791, 2807, 2821, 2832, 2843, 2854, 2862, 2870, 2878, 2889, 2900, 2911, 2919, 2927, 2935, 2943, 2951, 2959, 2967, 2975, 2983, 2991, 2999, 3007, 3015, 3023, 3031, 3039, 3047, 3055, 3063, 3071, and 3079.

41. The composition of matter of Embodiments 1-29, wherein $X_{aa}^{6}$ is 2-Abu.

42. The composition of matter of Embodiment 41, wherein $X_{aa}^{27}$ is Glu.

43. The composition of matter of Embodiments 41-42, wherein $X_{aa}^{29}$ is Asp, Glu, or Gln.

44. The composition of matter of Embodiment 41, comprising an amino acid sequence selected from SEQ ID NOS: 605, 636, 649, 706, 707, 718, 753, 758, 797, 799, 801, 804, 807, 808, 1029, 1041, 1042, 1048, 1066, 1067, 1083, 1097, 1111, 1125, 1136, 1147, 1158, 1166, 1174, 1182, 1193, 1204, 1215, 1223, 1231, 1239, 1250, 1261, 1272, 1280, 1288, 1296, 1307, 1318, 1329, 1337, 1345, 1353, 1361, 1369, 1377, 1385, 1393, 1401, 1409, 1417, 1425, 1433, 1441, 1449, 1457, 1465, 1473, 1481, 1489, 1497, 1505, 1513, 1521, 1529, 1537, 1545, 1553, 1561, 1569, 1577, 1585, 1593, 1601, 1609, 1617, 1625, 1633, 1641, 1659, 1673, 1687, 1701, 1712, 1723, 1734, 1742, 1750, 1758, 1769, 1780, 1791, 1799, 1807, 1815, 1826, 1837, 1848, 1856, 1864, 1872, 1883, 1894, 1905, 1913, 1921, 1929, 1937, 1945, 1953, 1961, 1969, 1977, 1985, 1993, 2001, 2009, 2017, 2025, 2033, 2041, 2049, 2057, 2065, 2073, 2081, 2089, 2097, 2105, 2113, 2121, 2129, 2137, 2145, 2153, 2161, 2169, 2177, 2185, 2193, 2201, 2209, 2217, 2235, 2249, 2263, 2277, 2288, 2299, 2310, 2318, 2326, 2334, 2345, 2356, 2367, 2375, 2383, 2391, 2402, 2413, 2424, 2432, 2440, 2448, 2459, 2470, 2481, 2489, 2497, 2505, 2513, 2521, 2529, 2537, 2545, 2553, 2561, 2569, 2577, 2585, 2593, 2601, 2609, 2617, 2625, 2633, 2641, 2649, 2657, 2665, 2673, 2681, 2689, 2697, 2705, 2713, 2721, 2729, 2737, 2745, 2753, 2761, 2769, 2777, 2785, 2793, 2809, 2823, 2834, 2845, 2856, 2864, 2872, 2880, 2891, 2902, 2913, 2921, 2929, 2937, 2945, 2953, 2961, 2969, 2977, 2985, 2993, 3001, 3009, 3017, 3025, 3033, 3041, 3049, 3057, 3065, 3073, and 3081.

45. The composition of matter of Embodiments 1-29, wherein $X_{aa}^{6}$ is Nle.

46. The composition of matter of Embodiment 45, wherein $X_{aa}^{27}$ is Glu.

47. The composition of matter of Embodiments 45-46, wherein $X_{aa}^{29}$ is Asp, Glu, or Gln.

48. The composition of matter of Embodiment 45, comprising an amino acid sequence selected from SEQ ID NOS: 607, 638, 651, 1085, 1099, 1113, 1127, 1138, 1149, 1160, 1168, 1176, 1184, 1195, 1206, 1217, 1225, 1233, 1241, 1252, 1263, 1274, 1282, 1290, 1298, 1309, 1320, 1331, 1339, 1347, 1355, 1363, 1371, 1379, 1387, 1395, 1403, 1411, 1419, 1427, 1435, 1443, 1451, 1459, 1467, 1475, 1483, 1491, 1499, 1507, 1515, 1523, 1531, 1539, 1547, 1555, 1563, 1571, 1579, 1587, 1595, 1603, 1611, 1619, 1627, 1635, 1643, 1661, 1675, 1689, 1703, 1714, 1725, 1736, 1744, 1752, 1760, 1771, 1782, 1793, 1801, 1809, 1817, 1828, 1839, 1850, 1858, 1866, 1874, 1885, 1896, 1907, 1915, 1923, 1931, 1939, 1947, 1955, 1963, 1971, 1979, 1987, 1995, 2003, 2011, 2019, 2027, 2035, 2043, 2051, 2059, 2067, 2075, 2083, 2091, 2099, 2107, 2115, 2123, 2131, 2139, 2147, 2155, 2163, 2171, 2179, 2187, 2195, 2203, 2211, 2219, 2237, 2251, 2265, 2279, 2290, 2301, 2312, 2320, 2328, 2336, 2347, 2358, 2369, 2377, 2385, 2393, 2404, 2415, 2426, 2434, 2442, 2450, 2461, 2472, 2483, 2491, 2499, 2507, 2515, 2523, 2531, 2539, 2547, 2555, 2563, 2571, 2579, 2587, 2595, 2603, 2611, 2619, 2627, 2635, 2643, 2651, 2659, 2667, 2675, 2683, 2691, 2699, 2707, 2715, 2723, 2731, 2739, 2747, 2755, 2763, 2771, 2779, 2787, 2795, 2811, 2825, 2836, 2847, 2858, 2866, 2874, 2882, 2893, 2904, 2915, 2923, 2931, 2939, 2947, 2955, 2963, 2971, 2979, 2987, 2995, 3003, 3011, 3019, 3027, 3035, 3043, 3051, 3059, 3067, 3075, and 3083.

49. The composition of matter of Embodiments 1-29, wherein $X_{aa}^{6}$ is Nva.

50. The composition of matter of Embodiment 49, wherein $X_{aa}^{27}$ is Glu.

51. The composition of matter of Embodiments 49-50, wherein $X_{aa}^{29}$ is Asp, Glu, or Gln.

52. The composition of matter of Embodiment 49, comprising an amino acid sequence selected from SEQ ID NOS: 606, 637, 650, 705, 708, 717, 759, 760, 805, 806, 1084, 1098, 1112, 1126, 1137, 1148, 1159, 1167, 1175, 1183, 1194, 1205, 1216, 1224, 1232, 1240, 1251, 1262, 1273, 1281, 1289, 1297, 1308, 1319, 1330, 1338, 1346, 1354, 1362, 1370, 1378, 1386, 1394, 1402, 1410, 1418, 1426, 1434, 1442, 1450, 1458, 1466, 1474, 1482, 1490, 1498, 1506, 1514, 1522, 1530, 1538, 1546, 1554, 1562, 1570, 1578, 1586, 1594, 1602, 1610, 1618, 1626, 1634, 1642, 1660, 1674, 1688, 1702, 1713, 1724, 1735, 1743, 1751, 1759, 1770, 1781, 1792, 1800, 1808, 1816, 1827, 1838, 1849, 1857, 1865, 1873, 1884, 1895, 1906, 1914, 1922, 1930, 1938, 1946, 1954, 1962, 1970, 1978, 1986, 1994, 2002, 2010, 2018, 2026, 2034, 2042, 2050, 2058, 2066, 2074, 2082, 2090, 2098, 2106, 2114, 2122, 2130, 2138, 2146, 2154, 2162, 2170, 2178, 2186, 2194, 2202, 2210, 2218, 2236, 2250, 2264, 2278, 2289, 2300, 2311, 2319, 2327, 2335, 2346, 2357, 2368, 2376, 2384, 2392, 2403, 2414, 2425, 2433, 2441, 2449, 2460, 2471, 2482, 2490, 2498, 2506, 2514, 2522, 2530, 2538, 2546, 2554, 2562, 2570, 2578, 2586, 2594, 2602, 2610, 2618, 2626, 2634, 2642, 2650, 2658, 2666, 2674, 2682, 2690, 2698, 2706, 2714, 2722, 2730, 2738, 2746, 2754, 2762, 2770, 2778, 2786, 2794, 2810, 2824, 2835, 2846, 2857, 2865, 2873, 2881, 2892, 2903, 2914, 2922, 2930, 2938, 2946, 2954, 2962, 2970, 2978, 2986, 2994, 3002, 3010, 3018, 3026, 3034, 3042, 3050, 3058, 3066, 3074, and 3082.

53. The composition of matter of Embodiment 1, comprising an amino acid sequence selected from SEQ ID NOS: 3-30, 32-72, 74-134, 136-178, 180-211, 218-239, 241-305, 307-363, 366-386, 388-432, 434-474, 515-527, 532-588, 590, 591, 593-775, 777, 778, 780-788, 790-1049, and 1062-3086.

54. A composition of matter, comprising an amino acid sequence selected from SEQ ID NOS: 3-134, 136-305, 307-386, 388-474, 515-527, 532-588, 590, 591, 593-1049, and 1062-3086.

55. An isolated nucleic acid encoding any of SEQ ID NOS: 3-134, 136-305, 307-386, 388-474, 515-527, 532-588, 590, 591, 593-1049, or 1062-3086 that does not include a non-canonical amino acid.

56. An expression vector comprising the nucleic acid of Embodiment 55.

57. A recombinant host cell comprising the expression vector of Embodiment 56.

58. The composition of matter of any of Embodiments 1-54, further comprising an optional linker moiety and a pharmaceutically acceptable, covalently linked half-life extending moiety.

59. The composition of matter of Embodiment 58, wherein the half-life extending moiety is polyethylene glycol of molecular weight of about 1000 Da to about 100000 Da, an IgG Fc domain, a transthyretin, or a human serum albumin.

60. The composition of matter of Embodiment 58, wherein the half-life extending moiety comprises a human immunoglobulin or a human immunoglobulin Fc domain, or both.

61. The composition of matter of Embodiment 60 having a configuration as set forth in any of FIGS. 12A-N, or FIGS. 88-91.

62. The composition of matter of Embodiment 60, wherein the composition comprises a monovalent immunoglobulin-peptide or Fc-peptide conjugate.

63. The composition of matter of Embodiment 60, wherein the composition comprises a bivalent immunoglobulin-peptide or Fc-peptide conjugate.

64. A pharmaceutical composition, comprising the composition of matter of any of Embodiments 1-54 or 58-63, and a pharmaceutically acceptable carrier.

65. A method of preventing pain, comprising administering a prophylactically effective amount of the composition of matter of any of Embodiments 1-54 or 58-63.

66. A method of treating pain, comprising administering a therapeutically effective amount of the composition of matter of any of Embodiments 1-54, or 58-63.

67. The method of Embodiment 66, wherein the pain is chronic pain, acute pain, or persistent pain.

68. The method of Embodiment 67, wherein the chronic pain is associated with cancer, chemotherapy, osteoarthritis, fibromyalgia, primary erythromelalgia, post-herpetic neuralgia, painful diabetic neuropathy, idiopathic painful neuropathy, neuromas, paroxysmal extreme pain disorder, migraine, trigeminal neuralgia, orofacial pain, cluster headaches, complex regional pain syndrome (CRPS), failed back surgery syndrome, sciatica, interstitial cystitis, pelvic pain, lower back pain, inflammation-induced pain, or joint pain.

69. The method of Embodiment 67, wherein the acute or persistent pain is associated with trauma, burn, or surgery.

70. The composition of matter of Embodiments 1-30, wherein $X_{aa}^{29}$ is an acidic or neutral hydrophilic residue.

71. The composition of matter of Embodiment 70, wherein $X_{aa}^{29}$ is selected from Ala, Asp, Glu, Gly, Asn, Gln, Ser, Thr, phosphoserine, phosphotyrosine, and gamma-carboxyglutamic acid residues.

72. The composition of matter of Embodiment 70, comprising an amino acid sequence selected from SEQ ID NOS: 1071-2798.

The following working examples are illustrative and not to be construed in any way as limiting the scope of the present invention.

EXAMPLES

Example 1

Isolation and Purification of GpTx-1 from Venom

Venom Sample Preparation.

Venom from the tarantula *Gammostola porteri* was extracted via electrical stimulation of an anesthetized spider. Venom samples were collected, lyophilized, and dissolved in 0.1% trifluoroacetic acid (TFA) in water to approximately 1 mg venom/mL. The crude venom solutions were desalted by solid-phase extraction (SPE) with Sep-Pak C18 cartridges (Waters, Milford, Mass., USA) equilibrated in 0.1% TFA, and eluted with 60% aqueous acetonitrile and then evaporated. The dried material was dissolved in 0.1% TFA to 1 mg venom/mL concentration and higher molecular components removed with a 10 kDa molecular weight cut-off Ultrafree-CL (Millipore). The <10 kDa venom extract was then dried under in vacuo and stored at −80° C.

Fractionation.

The crude venom was fractionated by reversed phase (RP) HPLC, collecting 84 samples in time slices. Less than 10 kDa venom extracts were dissolved in 0.1% TFA to approximately 1 mg venom/mL, and then separated by C18 RP HPLC chromatography and collected into approximately 1 minute wide fractions. HPLC method: Buffer A (0.1% TFA in water) and buffer B (90% acetonitrile/10% water containing 0.1% TFA) at 1 mL/min with a 1%/min gradient 0-100% buffer B. The fractions were then transferred into a plate format, dried under in vacuo, and then stored at −80° C.

Figure 1:
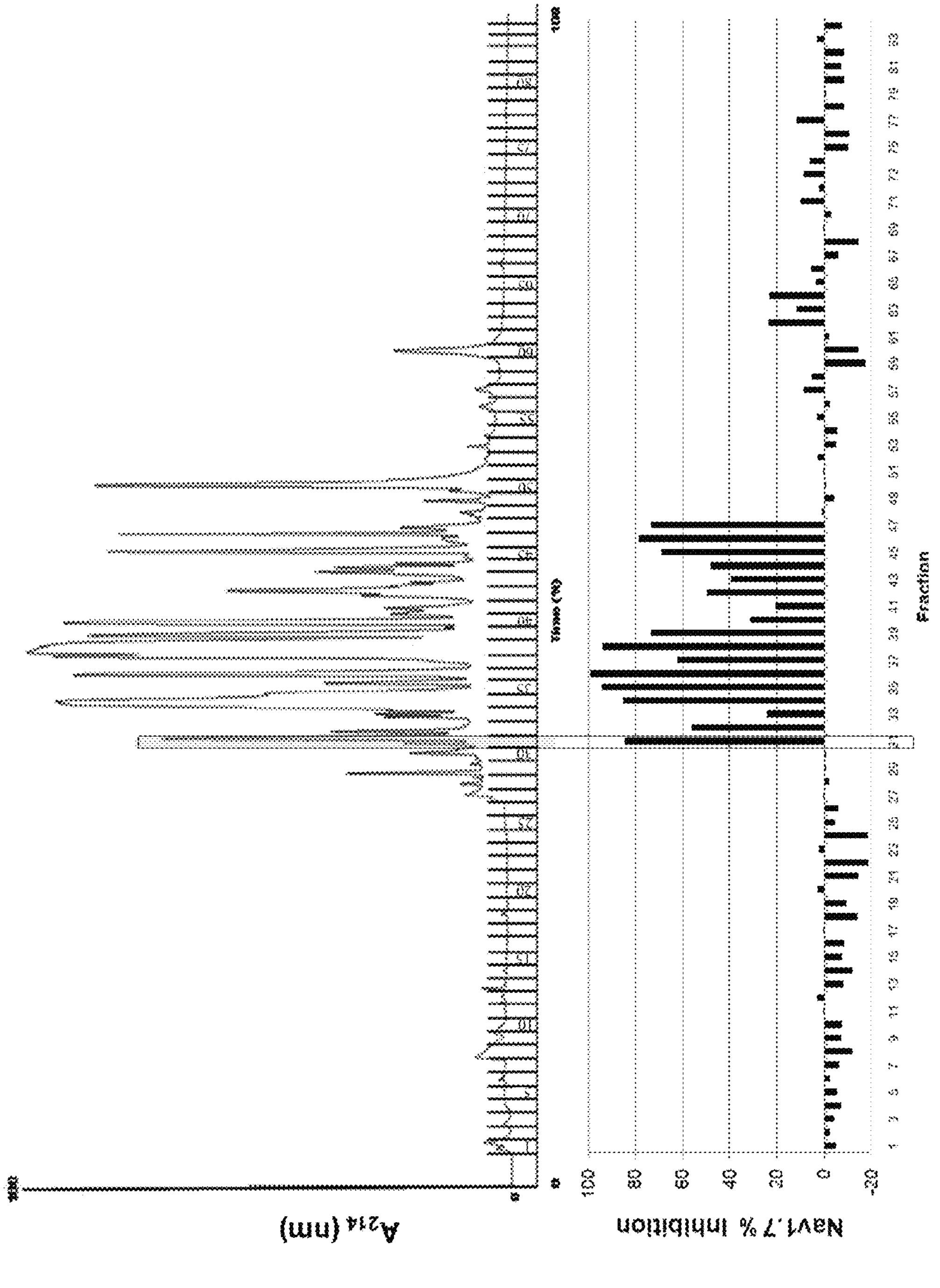
FIG. 1 (top panel) shows the reversed phase (RP) HPLC separation of crude venom extracted from *Grammostola porteri*. The tick marks along the x-axis represent time slices of fractionation.
Figure 3:
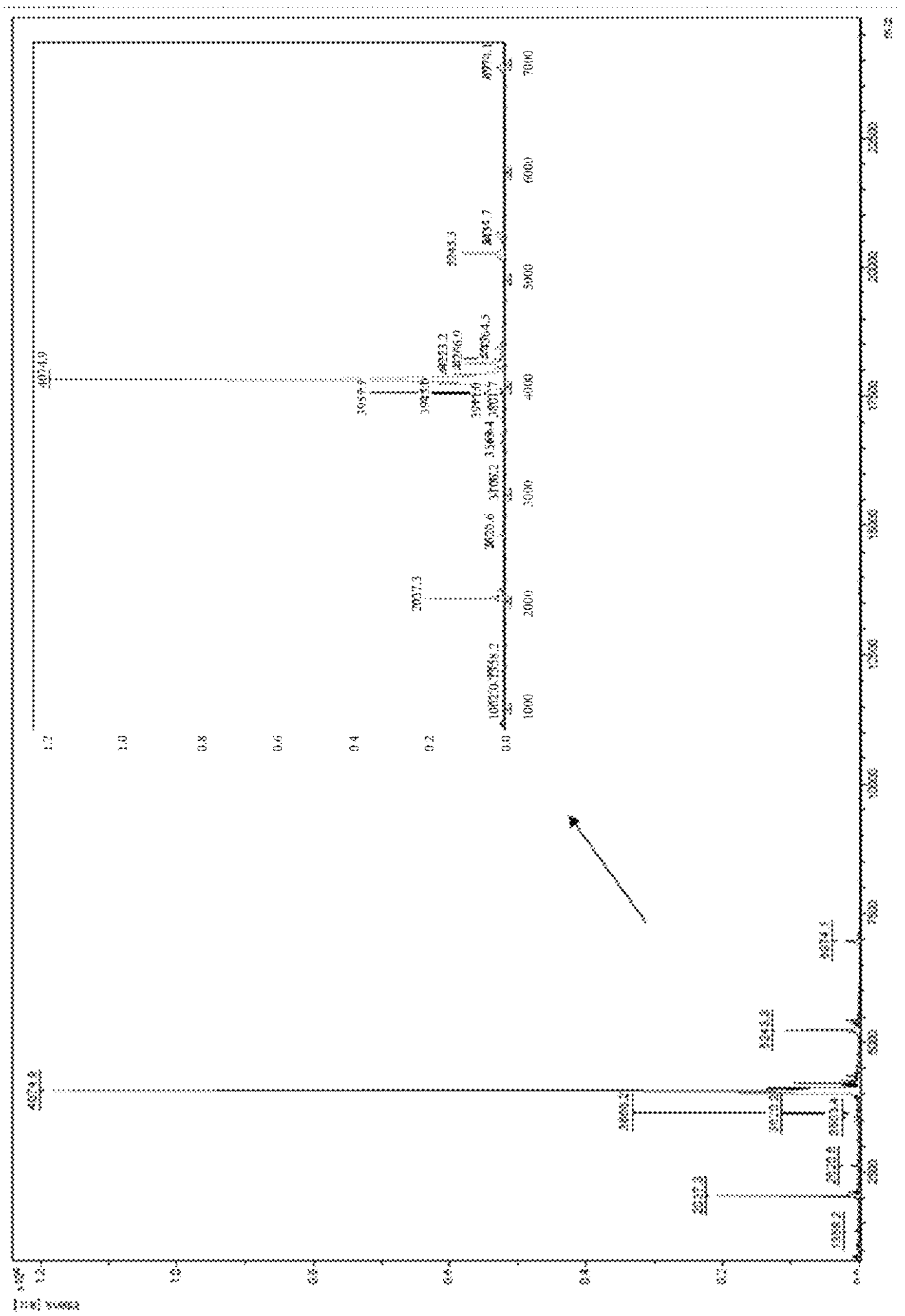
FIG. 3 shows the matrix-assisted laser desorption ionization time-of-flight mass spectrometry (MALDI-TOF MS) analysis of fraction 31 from the separation of *Grammostola*

The venom fractions were screened for activity in the $Na_V1.7$ and $Na_V1.3$ IonWorks® Quatrro (IWQ) patch clamp system-based assays. (See, Example 3 and FIG. 1). Several fractions with significant (>80% of control) Nav1.7 inhibitory activity were identified, the first of which was fraction 31. A second aliquot of fraction 31 was tested in the $Na_V1.7$, $Na_V1.3$, and $Na_V1.5$ IWQ assays to confirm the activity of the "hit" and evaluate selectivity. The sample was then analyzed by high-resolution electro-spray ionization (ESI) and matrix-assisted laser desorption ionization time-of-flight (MALDI-TOF) mass spectrometry (MS), which indicated that the fraction was a mixture of at least four distinct peptide species. (See, FIG. 2 and FIG. 3). Fraction 31 was then separated by RP-HPLC, and the corresponding sub-fractions were screened for activity in the $Na_V1.7$ and $Na_V1.5$ assays. Sub-fraction 11 was the major peak in the RP-HPLC chromatogram and showed >90% inhibition of $Na_V1.7$ activity. (See FIG. 4). Deconvolution of sub-fraction 11 revealed the primary peptide sequence of GpTx-1. As with all proteins, GpTx-1 is expected to have essentially zero access to the central nervous system.

GpTx-2 through GpTx-7 (SEQ ID NOS:467-474; see, Table 5A) were identified through transcriptomic analysis of the venom gland of *Grammostola porteri* using expressed sequence tag methodologies. (See, Siang A S, Doley R, Vonk F J, Kini R M., "Transcriptomic analysis of the venom gland of the red-headed krait (*Bungarus flaviceps*) using expressed sequence tags", *BMC Molecular Biology* 2010, 11:24; Jiang Y, Li Y, Lee W, Xu X, Zhang Y, Zhao R, Zhang Y, Wang W., "Venom gland transcriptomes of two elapid snakes (*Bungarus multicinctus* and Naja atra) and evolution of toxin genes", *BMC Genomics* 2011, 12:1; Wagstaff S C, Sanz L, Juárez P, Harrison R A, Calvete J J., "Combined snake venomics and venom gland transcriptomic analysis of the ocellated carpet viper, *Echis ocellatus.", J Proteomics.* 2009 71(6):609-23; Magalhães G S, Junqueira-de-Azevedo I L, Lopes-Ferreira M, Lorenzini D M, Ho P L, Moura-da-Silva A M. "Transcriptome analysis of expressed sequence tags from the venom glands of the fish *Thalassophryne nattereri", Biochimie* 2006 88(6):693-9; Wagstaff S C, Harrison R A., "Venom gland EST analysis of the saw-scaled viper, *Echis ocellatus*, reveals novel alpha9beta1 integrin-binding motifs in venom metalloproteinases and a new group of putative toxins, renin-like aspartic proteases." *Gene* 2006 377:21-32).

Peptide Sequencing: Edman Degradation and De Novo MS/MS.

N-terminal sequencing of peptides were performed by Edman degradation (Reference: (1) Edman, P. (1950), "Method for determination of the amino acid sequence in peptides", Acta Chem. Scand. 4: 283-293; (2) Niall, H. D. (1973). "Automated Edman degradation: the protein sequenator". Meth. Enzymol. 27: 942-1010). Phenylthiohydantoin (PTH)-amino acid derivatives were analyzed with an Applied Biosystems automatic 473A sequencer.

De novo peptide sequencing was accomplished by tandem mass spectrometry (References: Vlado Dančík, Theresa A. Addona, Karl R. Clauser, James E. Vath, Pavel A. Pevzner., J. Comp. Biol., Volume 6, 3/4, (1999); (2) Favreau, P., Menin, L., Michalet, S., Perret, F., Cheneval, Stöcklin, M., Bulet, A. and Stöcklin, R., Toxicon, 47(6), 676-687, (2006), (3) Favreau, P., Cheneval, O., Menin, L., Michalet, S., Gaertner, H., Principaud, F., Thai, R., Ménez, A., Bulet, P. and Stöcklin, R. (2007), The venom of the snake genus *Atheris* contains a new class of peptides with clusters of histidine and glycine residues. Rapid Communications in Mass Spectrometry, 21: 406-412).

Example 2

Synthesis of GpTx-1 Peptide Analogs

Small-Scale Peptide Synthesis.

Peptides were assembled using $N^{\alpha}$-Fmoc solid-phase peptide synthesis methodologies with appropriate orthogonal protection and resin linker strategies. The peptides were synthesized on a 0.012 mmol scale using Rink Amide MBHA resin (100-200 mesh, 1% DVB, RFR-1063-PI, 0.52 meq/g initial loading, 408291, Peptides International, Louisville, Ky.). Dry resin (17 mg per well) was added to a Phenomenex deep well protein precipitation plate (CEO-7565, 38710-1) using a resin loader (Radley). Amino acids were added to the growing peptide chain by stepwise addition using standard solid phase methods on an automated peptide synthesizer (Intavis Multipep). Amino acids (5 molar equivalents, 120 μL, 0.5 M in DMF) were pre-activated (1 min) with (1-Cyano-2-ethoxy-2-oxoethylidenaminooxy)dimethylamino-morpholino-carbenium hexafluorophosphate (COMU® coupling reagent; 5 molar equivalents, 170 μL, 0.35 M in dimethylformamide (DMF)) and N,N-Diisopropylethylamine (DIEA; 7.5 molar equivalents, 70 μL, 1.25 M in dichloromethane (DCM)). Pre-activated amino acids were transferred to the appropriate well. Resins were incubated for 30 min, drained, and the cycle repeated. Following the $2^{nd}$ amino acid incubation the plates were drained and washed with DMF 8 times (3 mL per column of 8 wells). The Fmoc groups were then removed by 2 sequential incubations in 500 μL of a 20% piperidine in DMF solution. The $1^{st}$ incubation was 5 min, the resin drained, and the $2^{nd}$ incubation was for 20 min. The resin was drained and washed with DMF 10 times (3 mL per column of 8 wells). After removal of the final Fmoc protecting group, the resin was washed with DCM 5 times (3 mL per column of 8 wells) and allowed to air dry.

Cleavage.

To the bottom of the filter plate was affixed a drain port sealing mat (ArcticWhite, AWSM-1003DP). To the resin in each well was added triisopropylsilane (100 μL), DODT (100 μL), and water (100 μL) using a multichannel pipette. To the resin in each well was added TFA (1 mL) using a Dispensette Organic dispenser. To the resin was added a triangular micro stir bar, and the mixture was stirred for 3 h. The sealing mat was removed, and the cleavage solution was eluted into a solid bottom 96-well deep well plate. The resin in each well was washed with and additional 1 mL of TFA. The solutions were concentrated using rotary evaporation (Genevac). To each well in a new 96-well filter plate with a bottom sealing mat attached was added 1 mL of cold diethyl ether using a Dispensette Organic dispenser. To the ether was added the concentrated peptide solutions using a multichannel pipette with wide bore tips. The solution was agitated with the pipette to ensure complete mixing and precipitation. The white solid was filtered, washed with a second 1 mL of cold ether, filtered, and dried under vacuum.

Folding.

To the crude peptide in each well was added 0.9 mL of 50:50 water/acetonitrile with a multichannel pipette and a micro stir bar. The mixture was stirred for 1 h. The solution was filtered into a solid bottom 96-well deep well plate. To the crude peptide in each well was added another 0.9 mL of 50:50 water/acetonitrile with a multichannel pipette. The solution was filtered into the same solid bottom 96-well deep well plate. In a 4 L bottle was prepared 4.0 L of folding buffer (3.3 L water, 300 mL acetonitrile, 2.0 g oxidized glutathione, 1.0 g reduced glutathione, 400 mL 1 M Tris-HCl pH 7.5). To 96 50-mL centrifuge tubes was added 40 mL of peptide folding buffer using a Dispensette dispenser. To the folding buffer was added the 1.8 mL of dissolved peptide using the Tecan automated liquid handler. The pH of the folding solutions was measured to about 7.7. The folding reactions were allowed to stand overnight. To each tube was added 1 mL of glacial acetic acid. To a 96-well filter plate was added SP Sepharose High Performance as a slurry (1 mL per well) with a multichannel pipette. Using the Tecan automated liquid handler, the gel was conditioned with folding buffer (3×0.9 mL), loaded with the folded peptide solution (50×0.9 mL, pH=4.0, on the Tecan automated liquid handler), washed (4×0.9 mL, 20 mM NaOAc, pH=4.0), and eluted manually on a vacuum manifold with 2×1 mL (1 M NaCl, 20 mM NaOAc, pH=4.0) into a solid bottom 96-well deep well plate.

Conjugation of Peptides to PEG.

Some GpTx-1 peptide analogs were conjugated to azido-NPEG10 (e.g., see, Table 30, Table 31, and Table 32, below). To 1 mL of the folded peptide in the IEX elution buffer was added in order 32-azido-3,6,9,12,15,18,21,24,27,30-decaoxadotriacontan-1-amine (70 μL, 50 mM aq.), tris(2-phenyl-1-(1H-1,2,3-triazol-4-yl)ethyl)amine (TBTA; 88 μL, 10 mM in DMSO), L-ascorbic acid sodium salt (438 μL, 75 mM aq.), and copper(ii) sulfate, anhydrous, powder (188 μL, 35 mM aq.). The reaction mixture turned slightly cloudy after the addition of the TBTA. After overnight incubation, the plate was centrifuged for 1 h at 1600 rpm to pellet any precipitate. The supernatant was transferred to a 96-well filter plate with a multichannel pipette and filtered into a solid bottom 96-well plate.

Purification and Characterization of Molecules.

The folded (conjugated) peptide (2 mL) was purified by mass-triggered semi-prep HPLC (Agilent/LEAP 'Ariel', Jupiter 5u C18 300 A, 100×10 mm 5 micron) with a gradient of 15-35% B over 45 min, with a 5 min flush, and 5 min equilibration at 8 mL/min. The collected fractions were pooled and reformatted into vials on the Tecan. Final QC (Phenomenex Jupiter 20×2 mm, 100 Å, 5 micron column eluted with a 10 to 60% B over 10 min gradient at a 0.750 mL/min flow rate monitoring absorbance at 220 nm) and CLND quantification were performed. Peptides with >95% purity and correct (m/z) ratio were screened. (See FIGS. 5 and 6 for LC-MS characterization of synthetic GpTx-1).

Large-Scale Peptide Synthesis.

Rink Amide Chem Matrix resin (0.2 mmol, 0.45 mmol/g loading, 0.444 g, Matrix Innovation) was weighed into a CS BIO reaction vessel. The reaction vessel was connected to a channel of the CS BIO 336X automated peptide synthesizer, and the resin was washed 2×DMF and allowed to swell in DMF for 15 min. Fmoc-amino acid (1.0 mmol, Midwest Biotech or Novabiochem) was dissolved in 2.5 mL of 0.4 M 6-chloro-1-hydroxybenzotriazole (6-Cl-HOBt, Matrix Innovation) in DMF. To the solution was added 1.0 mL of 1.0 M 1,3-diisopropylcarbodiimide (DIC, Sigma-Aldrich) in DMF. The solution was agitated with nitrogen bubbling for 15 min to accomplish pre-activation and then added to the resin. The mixture was shaken for 2 h. The resin was filtered and washed 3×DMF, 2×DCM, and 3×DMF. Fmoc-removal was accomplished by treatment with 20% piperidine in DMF (5 mL, 2×15 min, Fluka). The resin was filtered and washed 3×DMF. All residues were single coupled through repetition of the Fmoc-amino acid coupling and Fmoc removal steps described above.

Cleavage and Linear Peptide Purification.

After final Fmoc-removal from the N-terminal residue, resin-bound linear peptide (0.2 mmol scale) was transferred to a 25 mL solid phase extraction (SPE) filter tube, washed 3×DMF and 3×DCM, and dried under vacuum. To the resin was added triisopropylsilane (1.0 mL), 3,6-dioxa-1,8-octanedithiol (DODT, 1.0 mL), water (1.0 mL), trifluoroacetic acid (TFA, 15 mL), and a stir bar, and the mixture was stirred for 3 h. The mixture was filtered into a 50 mL centrifuge tube. The resin was washed with TFA (~5 mL), and the combined filtrate was concentrated by rotary evaporation in a Genevac HT-12 (30° C. chamber temperature, pressure ramp from 500 to 50 mbar over 40 min and a final pressure of 8 mbar for 2 h). To the residue (~5 mL) was added 40 mL cold diethyl ether. A white precipitate formed. The solid was stirred in the ether. The mixture was centrifuged (4 min, 4,400 rpm), and the ether was decanted. To the tube was added another 40 mL of cold ether, and the precipitate was stirred. The mixture was centrifuged, and the ether was decanted. The solid was dried overnight under vacuum. The crude linear peptide was purified by preparative LC-MS. The filtered sample (500 mg in 10 mL DMSO) was injected onto a preparative HPLC column (Jupiter 10u C18 300 A, 250×50 mm 10 micron). The peptide was eluted with a 10-40% B over 60 min gradient at 50 mL/min, followed by a 10 min flush and a 10 min equilibration. The fractions were analyzed by LC-MS, pooled, and lyophilized to afford pure the linear peptide precursor.

Folding.

In a 2 L FEP bottle was prepared a folding buffer with water (944 mL), acetonitrile (55.5 mL), Tris-HCl pH 7.5 (111 mL), (−)-glutathione, oxidized (680 mg, 1.110 mmol), and 1-glutathione reduced (340 mg, 1.110 mmol). To the pure linear peptide (111 mg, 0.028 mmol) was added 2.5 mL acetonitrile and 2.5 mL water. The mixture was vortexed to complete dissolution of the peptide. The peptide solution was added to the folding buffer (0.1 mg/mL peptide concentration, 1 mM oxidized glutathione, 1 mM reduced glutathione, 10% v/v acetonitrile, 0.1 M Tris pH 7.5). The pH value was measured to be 7.7. The folding mixture was stirred at 80 rpm at room temperature overnight. A small aliquot was removed and the sample was analyzed by LC-MS to ensure that the folding was complete. The solution was quenched by the addition of 4 mL AcOH and 4 mL TFA (pH=2.5). The aqueous solution was filtered (0.45 uM cellulose membrane).

Purification.

The filtered solution (1110 mL, 111 mg peptide) was loaded onto a preparative HPLC column (Phenomenex Synergi 4u MAX-RP 80A AXIA, 250×30 mm) at 30 mL/min using an Agilent preparative loading pump. The column was flushed for 10 min with 10% B at 30 mL/min to elute the AcOH/TFA. The column was attached to a prep HPLC, Agilent/LEAP prep LC-MS, and the peptide was eluted with a 10-40% B gradient over 60 min, followed by a 10 min flush and a 10 min equilibration. The fractions were analyzed by LC-MS, pooled, and lyophilized to afford pure folded peptide.

Counterion Exchange for Peptide In Vivo Studies.

A 4 mL SPE tube containing VariPure IPE (Varian, PL-HCO3 MP-Resin, polymer-supported hydrogencarbonate, 1.8 mmol/g, 100 A, 150-300 μm) was pre-conditioned with 2 mL of MeOH, followed by 2 mL of water, draining by gravity. 2.0 mL of a ≤5.0 mM solution of purified folded peptide in water was applied to the bed. The device was washed with 4×2.0 mL of water to elute all of the peptide. To the eluent was added 50 μL of acetic acid. The solution was concentrated by rotary evaporation (Genevac) to afford the acetate salt of the purified folded peptide. A 100 mM stock solution of trifluoroethanol (TFE) in deuterium oxide (D2O) was prepared fresh by weighing 50 mg of TFE into a 5 mL volumetric flask, followed by addition of D2O to a final volume of 5 mL. A 5 mM solution of TFE in D2O was then prepared by dilution for dissolving all samples for $^{19}$F-NMR. The solution was used to dissolve peptide to a concentration of 1 mM, and the sample was analyzed by $^{19}$F-NMR using a fluorine long delay (d1=5 sec) method. The TFE integral (triplet at −76.75 ppm) was normalized to 5 and the integral of TFA (singlet at −75.6) recorded. NMR tube was cut, and sample was recovered by rotary evaporation (Genevac).

Example 3

Electrophysiology

Cell Lines Expressing Nav Channels.

Stable cell lines constitutively expressing human (h) voltage-gated sodium (Nav) channels (HEK293-hNav1.2, CHO-hNav1.3, HEK293-hNav1.4, HEK293-hNav1.5, and HEK293-hNav1.7) or CHO cells expressing hNav1.8 under an inducible promoter were used for experiments.

Population Patch Clamp Electrophysiology Using IonWorks® Quattro Patch Clamp System.

Adherent cells were isolated from tissue culture flasks using 0.25% trypsin-EDTA treatment for 10 minutes and were resuspended in external solution consisting of 140 mM NaCl, 5.0 mM KCl, 10 mM HEPES, 2 mM $CaCl_2$, 1 mM $MgCl_2$, 10 mM Glucose, pH 7.4. Internal solution consisted of 70 mM KCl, 70 mM KF, 10 HEPES, 5 mM EDTA, pH 7.3. Cells were voltage clamped, using the perforated patch clamp configuration at room temperature (~22° C.), to −110 mV and depolarized to −10 mV before and 5 min after test compound addition. Compound dilutions contained 0.1% bovine serum albumin to minimize non-specific binding. Peak inward currents were measured from different cells for each compound concentration and $IC_{50}$ values were calculated with Excel software. All compounds were tested in duplicate (n=2).

Electrophysiology Using PatchXpress® 7000A Patch Clamp System.

Adherent cells were isolated from tissue culture flasks using 1:10 diluted 0.25% trypsin-EDTA treatment for 2-3 minutes and then were incubated in complete culture medium containing 10% fetal bovine serum for at least 15 minutes prior to resuspension in external solution consisting of 70 mM NaCl, 140 mM D-Mannitol, 10 mM HEPES, 2 mM $CaCl_2$, 1 mM $MgCl_2$, pH 7.4 with NaOH. Internal solution consisted of 62.5 mM CsCl, 75 mM CsF, 10 HEPES, 5 mM EGTA, 2.5 mM $MgCl_2$, pH 7.25 with CsOH. Cells were voltage clamped using the whole cell patch clamp configuration at room temperature (~22° C.) at a holding potential of −125 mV with test potentials to −10 mV (hNav1.2, hNav1.3, hNav1.4, and hNav1.7) or −20 mV (hNav1.5). To record from partially inactivated channels, cells were switched to a voltage that yielded ~20% channel inactivation. Test compounds were added and Nav currents were monitored at 0.1 Hz at the appropriate test potential. All compound dilutions contained 0.1% bovine serum albumin to minimize non-specific binding. Cells were used for additional compound testing if currents recovered to >80% of starting values following compound washout. $IC_{50}$ values were calculated by pooling single point determinations at different compound concentrations and fitting the resulting dataset with a Hill (4-parameter logistic) fit in DataXpress 2.0 software.

Whole Cell Patch Clamp Electrophysiology.

Cells were voltage clamped using the whole cell patch clamp configuration at room temperature (~22° C.). Pipette resistances were between 1.5 and 2.0 Ma Whole cell capacitance and series resistance were uncompensated. Currents were digitized at 50 kHz and filtered (4-pole Bessel) at 10 kHz using pClamp10.2. Cells were lifted off the culture dish and positioned directly in front of a micropipette connected to a solution exchange manifold for compound perfusion. To record from non-inactivated channels, cells were held at −140 mV and depolarized to −10 mV (0 mV for hNav1.8). To record from partially inactivated channels, cells were held at −140 mV initially and then switched to a voltage that yielded ~20% channel inactivation. 10 ms pulses were delivered every 10 seconds and peak inward currents were recorded before and after compound addition. Compound dilutions contained 0.1% bovine serum albumin to minimize non-specific binding. For hNav1.8 channel recordings, tetrodotoxin (TTX, 0.5 uM) was added to inhibit endogenous TTX-sensitive voltage-gated sodium channels and record only Nav1.8-mediated TTX-resistant currents. External solution consisted of: 140 mM NaCl, 5.0 mM KCl, 2.0 mM $CaCl_2$, 1.0 mM $MgCl_2$, 10 mM HEPES, and 11 mM Glucose, pH 7.4 by NaOH. Internal solution consisted of: 62.5 mM CsCl, 75 mM CsF, 2.5 mM $MgCl_2$, mM EGTA, and 10 mM HEPES, pH 7.25 by CsOH. Escalating compound concentrations were analyzed on the same cell and $IC_{50}$ values were calculated with Clampfit 10.2 software and by fitting the resulting dataset with a Hill (4-parameter logistic) fit in Origin Pro 8 software.

DRG Neuron Isolation.

Adult male and female C57BL/6 mice (Harlan Laboratories, Indianapolis, Ind.) were euthanized with sodium pentobarbital (Nembutal, 80 mg/kg, i.p., Western Med Supply, Arcadia, Calif.) followed by decapitation. DRG from cervical, thoracic and lumbar regions were removed, placed in $Ca^{2+}$ and $Mg^{2+}$-free Hanks' Balanced Salt Solution (Invitrogen, Carlsbad, Calif.), and trimmed of attached fibers under a dissecting microscope. DRG were sequentially digested at 37° C. with papain (20 U/ml, Worthington Biochemical Corporation, Lakewood, N.J.) and L-cysteine (25 μM) in $Ca^{2+}$ and $Mg^{2+}$-free Hanks' (pH 7.4) for 20-30 min and then with collagenase type 2 (0.9% w/v, Worthington Biochemical Corporation) for 20-30 min. Digestions were quenched with a 1:1 mixture of DMEM and Ham's F-12 Nutrient Mixture (Invitrogen) supplemented with 10% calf serum (Invitrogen), and cells were triturated with a fire-polished Pasteur pipette prior to plating on Poly-D-Lysine-coated glass coverslips (Cole-Parmer, Vernon Hills, Ill.). Cells were maintained in a humidified incubator at 28° C. with 5% $CO_2$ for 3-7 days in the presence of 1% NSF-1 (Lonza, Basel, Switzerland) to increase the expression of tetrodotoxin-sensitive sodium channel currents.

Manual Patch-Clamp Electrophysiology for DRG Neurons.

DRG neurons were voltage clamped using the whole-cell patch clamp configuration at room temperature (21-24° C.) using an Axopatch 200 B or MultiClamp 700 B amplifier and DIGIDATA 1322A with pCLAMP software (Molecular Devices, Sunnyvale, Calif.). Pipettes, pulled from borosilicate glass capillaries (World Precision Instruments, Sarasota, Fla.), had resistances between 1.0 and 3.0 MΩ. Voltage errors were minimized using >80% series resistance compensation. A P/4 protocol was used for leak subtraction. Currents were digitized at 50 kHz and filtered (4-pole Bessel) at 10 kHz. Cells were lifted off the culture dish and positioned directly in front of a micropipette connected to a solution exchange manifold for compound perfusion. Cells were held at −140 mV or a voltage yielding approximately 20% inactivation and depolarized to −10 mV for 40 msec every 10 seconds. Tetrodotoxin (TTX, Sigma) was used following peptide addition to block any residual TTX-sensitive sodium currents. Pipette solution contained (in mM): 62.5 CsCl, 75 CsF, 2.5 $MgCl_2$, 5 EGTA, and 10 HEPES, pH 7.25 by CsOH. Bath solution contained (in mM): 70 NaCl, 5.0 KCl, 2.0 $CaCl_2$, 1.0 $MgCl_2$, HEPES, and 11 glucose, 140 mannitol, pH 7.4 by NaOH. Data were analyzed with Clampfit and Origin Pro8 (OriginLab Corp, Northampton, Mass.).

Results of Electrophysiology Studies and Structure-Activity Relationship.

Results of electrophysiology studies are shown in Table 6 through Table 32, below. Extensive systematic analoging has given considerable insight into how individual positions within GpTx-1 (SEQ ID NO:1) contribute to its overall VGSC activity profile. Concerning the overall molecular framework, the disulfide bonds (or diselenide bonds) between Cys9 (or SeCys9) and Cys23 (or SeCys23) (C2-05) and between Cys16 (or SeCys16) and Cys30 (or SeCys30) (C3-C6) are essential for function. However, simultaneous substitution of Cys2 and Cys17, as in [2-Abu-2,17]GpTx-1 (SEQ ID NO: 125), which removes the (C1-C4) disulfide bond, retains significant activity against $Na_V1.7$ and $Na_V1.3$ with potentially improved selectivity against Nav1.4. (See, Table 29).

The N-terminal portion of GpTx-1, including the N-terminus, Asp1, Leu3, and Gly4, is amenable to modification without affecting either VGSC potency or selectivity in comparison with GpTx-1. (See, Table 7, Table 8, Table 9, and Table 10). Extension of the polypeptide chain by coupling additional amino acid(s) to the N-terminus is well-tolerated. (See Table 7). Acetylation of the N-terminal aspartic acid residue to give Ac-GpTx-1 (SEQ ID NO:132) maintains potency at $Na_V1.7$ and increases selectivity against $Na_V1.3$ and $Na_V1.4$ as measured by the PatchXpress® (PX) patch clamp system. (See, Table 30). Asp1 of GpTx-1 can be truncated or substituted with a variety of amino acids with no impact on potency at $Na_V1.7$ and $Na_V1.3$ or selectivity against $Na_V1.4$ and $Na_V1.5$. (See Table 8). Leu3 and Gly4 in GpTx-1 may be individually replaced with a hydrophobic or a basic amino acid and still retain potency against $Na_V1.7$ and $Na_V1.3$, but these positions are less tolerant of substitution with acidic residues. (See Table 9 and Table 10). However, substitution of glutamic acid for Leu3 increases selectivity against Nav1.4 in the PX assay format. (See Table 30).

Hydrophobic residues at positions 5 and 6 (Phe5 and Met6 in GpTx-1), in relation to SEQ ID NO:1, are essential to $Na_V1.7$ and $Na_V1.3$ inhibitory potency. (See Table 11 and Table 12). The identity of the amino acid at position 5 in GpTx-1 (SEQ ID NO:1) also has great impact on the selectivity of the peptide between $Na_V1.7$, $Na_V1.3$, and $Na_V1.4$. Substitution of aliphatic or aromatic hydrophobic residues for the native phenylalanine maintains or increases potency against $Na_V1.7$ while increasing selectivity against $Na_V1.4$ and not reducing the selectivity against $Na_V1.5$. (See Table 11). Incorporation of alanine in [Ala5]GpTx-1 (SEQ ID NO:22) retains potency against $Na_V1.7$ while greatly increasing selectivity against $Na_V1.3$ and Nav1.4 in the PX format. Besides alanine, many other aliphatic residues may be incorporated at position 5 to improve selectivity against Nav1.4, including but not limited to glycine, 2-aminobutyric acid (Abu), 2-aminoisobutyric acid (Aib), norvaline, valine, leucine, and isoleucine. (See Table 30). Two para-substituted phenylalanine derivatives, [pI-Phe5]GpTx-1 (SEQ ID NO:247) and [Bip5]GpTx-1 (SEQ ID NO:242) have increased potency against $Na_V1.3$ and are selective against $Na_V1.7$. (See Table 30). Incorporation of hydrophobic residues at position 6 increases potency against all four Nay sub-types tested in proportion to their size. (See Table 12). A variety of hydrophobic residues including leucine and phenylalanine can be incorporated at position 6 in combination with alanine at position 5 to maintain good potency against Nav1.7 and selectivity against Nav1.4 in the PX assay format. (See Table 30).

While each position has recognizable preferences, the sequence of amino acids from Arg8 to Thr26 is quite tolerant of individual substitutions, with the exception of Asp14 relative to SEQ ID NO:1. Peptides synthesized without an aspartic acid residue at position 14 of GpTx-1 have not been isolated in sufficiently pure form for screening, indicating this residue may be critical for proper folding of the peptide. Basic or neutral hydrophilic amino acids are acceptable as substitutions for Arg7 and Lys8, relative to SEQ ID NO:1, to maintain $Na_V1.7$ and $Na_V1.3$ inhibitory potency. (See Table 13). However, substitution of glutamic acid for Arg7 increases selectivity against Nav1.4 in the PX assay format. (See Table 30). Ile10, Pro11, Asp12, Asn13, Lys15, Arg18, and Pro19, relative to SEQ ID NO:1, can be substituted with a variety of amino acids with little effect on potency against $Na_V1.7$ and $Na_V1.3$. (See Table 14, Table 15, Table 16, Table 17, and Table 18). The ability to substitute alternative residues for Pro11, i.e., [Glu11]GpTx-1 (SEQ ID NO:147) and [Trp11]GpTx-1 (SEQ ID NO:171), without affecting Nav1.7 activity is notable, since this residue is conserved in the peptide sequences of HWTX-IV SEQ ID NO:528) and HWTX-I (SEQ ID NO:529). (See Table 15; FIG. 15A-B). Substitutions of acidic residues at positions 10 or 11 can improve selectivity against Nav1.4, i.e., [Asp10]GpTx-1 (SEQ ID NO:119), [Glu10]GpTx-1 (SEQ ID NO:146), and [Glu11]GpTx-1 (SEQ ID NO:147) (See Table 30). Substitution of Asn13 improves the Fmoc solid-phase synthesis of the peptide analogs, likely through reduction of aspartimide formation during subsequent Fmoc-removal steps. Substitutions at position 18 can improve selectivity against Nav1.4. (See Table 18 and Table 30). Asn20, Leu21, Val22, Ser24, Arg25, and Thr26, relative to SEQ ID NO:1, may be individually substituted with non-acidic amino acids and retain full Nav1.7 and Nav1.3 inhibitory potencies. (See Table 19, Table 20, Table 21, and Table 22). The threonine at position 26 of GpTx-1 (SEQ ID NO:1) differs from the conserved lysine in HWTX-IV (SEQ ID NO:528) and HWTX-I (SEQ ID NO:529; see FIG. 15A-B). Substitutions at this position increase selectivity against $Na_V1.4$ as in [Leu26]GpTx-1 (SEQ ID NO:121) and [Glu26]GpTx-1 (SEQ ID NO:152). (See Table 30). The loop in GpTx-1 (SEQ ID NO:1) between Cys17 and Cys23 may be increased or decreased in length by insertion or deletion of one amino acid residue without substantial impact on the activity of the peptide against the VGSCs tested, as shown by [Ser-Ser19]GpTx-1 (SEQ ID NO:93) and [Glu18;des-Asn20]GpTx-1 (SEQ ID NO:134). (See Table 18 and Table 29).

The C-terminal portion of the GpTx-1 sequence is most critical for the activity of the peptide against $Na_V1.7$ and $Na_V1.3$. Substitution of His27 in GpTx-1 (SEQ ID NO:1) with retention of potency and selectivity is best accomplished with aromatic and basic residues. See Table 23). Residues Lys28 and Val33, relative to SEQ ID NO:1, are most tolerant to substitution with a variety of different amino acids without affecting $Na_V1.7$ and $Na_V1.3$ inhibitory potency. (See Table 23 and Table 26). [Arg28]GpTx-1 (SEQ ID NO:72), [Glu28] GpTx-1 (SEQ ID NO:153), [Asp28]GpTx-1 (SEQ ID NO:750), [Gln28]GpTx-1 (SEQ ID NO:763), and [Glu33] GpTx-1 (SEQ ID NO:33), show increased selectivity against $Na_V1.4$. (See Table 30). A trytophan (or thiotryptophan) at position 29 of GpTx-1 (SEQ ID NO:1) appears to be important to obtain high levels of potency against $Na_V1.7$ and $Na_V1.3$. (See Table 24). Analogs with large hydrophobic substitutions, [1-Nal29]GpTx-1 (SEQ ID NO:79) and [2-Nal29] GpTx-1 (SEQ ID NO:129), retain the most activity but are still 5-fold less potent than GpTx-1, though they may have increased selectivity against Nav1.4. (See Table 30). Lys31, relative to SEQ ID NO:1, is also apparently important for potent inhibition of Nav1.7 and $Na_V1.3$ by GpTx-1. (See Table 25). The tyrosine at position 32 of GpTx-1 (SEQ ID NO:1) can be substituted with aliphatic or aromatic hydrophobic amino acids with retention of potency against $Na_V1.7$ and $Na_V1.3$, but these substitutions often increase activity against $Na_V1.5$ and $Na_V1.4$, leading to reduced selectivity. (See Table 25). The phenylalanine at position 34 of GpTx-1 (SEQ ID NO:1) can only be substituted with other hydrophobic amino acids without losing potency against $Na_V1.7$ and $Na_V1.3$, though large hydrophobic amino acids tend to increase potency and hence reduce selectivity against $Na_V1.4$ and $Na_V1.5$. (See Table 27). The C-terminus of GpTx-1 (SEQ ID NO:1) is amenable to extension by at least one amino acid with retention of $Na_V$ inhibitory activity, but truncation of the C-terminus of GpTx-1 or substitution of the native C-terminal amide with a free acid reduces potency against $Na_V1.7$ and $Na_V1.3$. (See Table 28). Additional analogs of GpTx-1 (SEQ ID NO:1) that combine individual substitutions have demonstrated further improvements in selectivity against $Na_V1.4$ and $Na_V1.5$ and potency toward Nav1.7 and Nav1.3, i.e., [Ala5,Phe6,Leu26,Arg28]GpTx-1 (SEQ ID NO:262) and [Ala5,Phe6,Glu10,2-Abu13,Leu26,Arg28]GpTx-1 (SEQ ID NO:1035). (See Table 29 and Table 30). The $IC_{50}$ of [Ala5] GpTx-1(1-34) (SEQ ID NO:22) against partially inactivated hNav1.2 channels was 0.265 μM.

Manual whole cell patch clamp electrophysiology was performed on GpTx-1 (SEQ ID NO:1) and [Ala5]GpTx-1 (SEQ ID NO:22) on human clones of Nav1.7, Nav1.3, Nav1.4, and Nav1.5. Testing with 100 nM GpTx-1 showed complete inhibition of the Nav1.7 current. (See FIG. 20). The $IC_{50}$ value of Nav1.7 inhibition for GpTx-1 was 7.40 nM. (See FIG. 21). The effects of GpTx-1 addition in increasing concentrations and wash out on Nav1.7 current were recorded. (See FIG. 22). Testing with 300 nM GpTx-1 showed complete inhibition of the Nav1.3 current. (See FIG. 23). The $IC_{50}$ value of Nav1.3 inhibition for GpTx-1 was 16.8 nM. (See FIG. 24). The effects of GpTx-1 addition in increasing concentrations and wash out on Nav1.3 current were recorded. (See FIG. 25). Testing with 3.0 μM GpTx-1 showed partial inhibition of the Nav1.4 current. (See FIG. 26). The $IC_{50}$ value of Nav1.4 inhibition for GpTx-1 was 2.9 μM and 0.26 μM for the closed and partially inactivated states, respectively. (See FIGS. 27 and 28). The effects of GpTx-1 addition in increasing concentrations and wash out on Nav1.4 current were recorded on the closed and partially inactivated states, respectively. (See FIGS. 29 and 30). GpTx-1 is more potent against hNav1.4 when channels are partially inactivated. Testing with 3.0 μM GpTx-1 showed weak inhibition of the Nav1.5 current. (See FIG. 31). The $IC_{50}$ value of Nav1.5 inhibition for GpTx-1 was 8.9 μM. (See FIG. 32). The effects of GpTx-1 addition in increasing concentrations and wash out on Nav1.5 current were recorded. (See FIG. 33). These results demonstrate that GpTx-1 (SEQ ID NO:1) is a potent dual peptide inhibitor of Nav1.7 and Nav1.3 with selectivity against Nav1.4 and Nav1.5. Testing with 300 nM [Ala5]GpTx-1 (SEQ ID NO:22) showed complete inhibition of the Nav1.7 current. (See FIG. 34). The $IC_{50}$ value of Nav1.7 inhibition for [Ala5] GpTx-1 was 13.2 nM. (See FIG. 35). The effects of [Ala5] GpTx-1 addition in increasing concentrations and wash out on Nav1.7 current were recorded. (See FIG. 36). These results demonstrate that [Ala5]GpTx-1 (SEQ ID NO:22) is also a potent inhibitor of Nav1.7.

Manual patch clamp electrophysiology was performed on GpTx-1 (SEQ ID NO:1) and [Ala5]GpTx-1 (SEQ ID NO:22) on isolated mouse DRG neurons. The effects of GpTx-1 addition in increasing concentrations and wash out on sodium channel current in mouse DRG neurons were recorded. (See FIG. 37). The $IC_{50}$ value of TTX-sensitive sodium channel current inhibition for GpTx-1 was 7.1 nM. (See FIG. 38). Testing with 200 nM GpTx-1 showed almost complete inhibition of the TTX-sensitive sodium current in mouse DRG neurons. (See, FIG. 39). The effects of GpTx-1 addition in increasing concentrations and wash out on sodium channel current in mouse DRG neurons at a holding voltage that produced 20% inactivation were recorded. (See FIG. 40). The $IC_{50}$ value of TTX-sensitive sodium channel current inhibition with a holding voltage yielding 20% inactivation for GpTx-1 was 4.7 nM. (See FIG. 41). Testing with 200 nM GpTx-1 showed complete inhibition of the TTX-sensitive sodium current in mouse DRG neurons with a holding voltage that yielded 20% inactivation (See, FIG. 42). The effects of [Ala5]GpTx-1 (SEQ ID NO:22) addition in increasing concentrations and wash out on sodium channel current in mouse DRG neurons were recorded. (See, FIG. 43). The $IC_{50}$ value of TTX-sensitive sodium channel current inhibition for [Ala5]GpTx-1 (SEQ ID NO:22) was 17.0 nM. (See FIG. 44). Testing with 300 nM GpTx-1 showed almost complete inhibition of the TTX-sensitive sodium current in mouse DRG neurons. (See, FIG. 45).

Manual whole cell patch clamp electrophysiology was performed on Homodimeric Conjugate 1 on human clones of Nav1.7 and Nav1.5 (see, Example 5). The effects of adding Homodimeric Conjugate 1 in increasing concentrations and wash out on Nav1.7 current were recorded. (See FIG. 46). The $IC_{50}$ value of Nav1.7 inhibition for Homodimeric Conjugate 1 was 1.2 nM. (See, FIG. 47). Testing with 3 nM Homodimeric Conjugate 1 showed that the compound was very slow to wash out during an extended wash (10 min), and testing with 300 nM Homodimeric Conjugate 1 showed that the compound did not wash out during an extended wash (10 min). (See FIG. 48). Testing with 300 nM Homodimeric Conjugate 1 gave complete inhibition of the Nav1.7 current. (See FIG. 49). The effects of Homodimeric Conjugate 1 addition in increasing concentrations and wash out on Nav1.7 current with a holding voltage that yielded ~20% inactivation were recorded. (See FIG. 50). The $IC_{50}$ value of Nav1.7 inhibition with a holding voltage that yielded ~20% inactivation for Homodimeric Conjugate 1 was 0.66 nM. (See FIG. 51). Testing with 3 nM Homodimeric Conjugate 1 gave complete inhibition of the Nav1.7 current with a holding voltage that yielded ~20% inactivation. (See FIG. 52). The effects of Homodimeric Conjugate 1 addition in increasing concentrations and wash out on Nav1.5 current were recorded. (See FIG. 53). The $IC_{50}$ value of Nav1.5 inhibition for Homodimeric Conjugate 1 was 75.5 nM. (See FIG. 54). Testing with 2 μM Homodimeric Conjugate 1 gave complete inhibition of the Nav1.5 current. (See FIG. 55). The effects of Homodimeric Conjugate 1 addition in increasing concentrations and wash out on Nav1.5 current with a holding voltage that yielded ~20% inactivation were recorded. (See FIG. 56). The $IC_{50}$ value of Nav1.5 inhibition with a holding voltage that yielded ~20% inactivation for Homodimeric Conjugate 1 was 57 nM. (See FIG. 57). Testing with 2 μM Homodimeric Conjugate 1 gave complete inhibition of the Nav1.5 current with a holding voltage that yielded ~20% inactivation. (See FIG. 58).

Potassium Channel Study.

Dorsal root ganglia were harvested from adult Sprague-Dawley rats (aged 14 to 15 weeks), trimmed of connective tissue, and enzymatically dissociated with papain (3 mL calcium and magnesium-free Hank's buffer+1 mg L-cysteine+4 uL saturated sodium bicarbonate+60 microliters papain, Worthington biochemical) for 30 minutes at 37° C. The preparation was spun at 1000 rpm for 2 minutes and the pellet was resuspended for a second enzymatic incubation in collagenase and dispase (4 mL calcium and magnesium-free Hank's buffer+120 microliters of collagenase/dispase mix 100 mg/mL from Roche) for 60 minutes with gentle trituration every 10 minutes. Cells were spun again at 2000 rpm for 2 minutes, resuspended in F-12 medium, plated on poly-D-laminin coated coverslips, placed in a humidified 37° C. incubator with 5% $CO_2$, and used for electrophysiological recording on the same day.

Electrophysiological recordings were made with the whole-cell configuration of the patch-clamp technique (Hamill O P et al., "Improved patch-clamp techniques for high-resolution current recording from cells and cell-free membrane patches, Pfluger's Archiv 391:85-100, 1981), with internal (pipette) solution containing, in millimolar, 70 KF, 70 KCl, 10 HEPES, 5 HEDTA, pH 7.25 with KOH. External solution contained, in millimolar, 140 NaCl, 5 KCl, 2 $CaCl_2$, 1 $MgCl_2$, 10 HEPES, 10 glucose, pH 7.4 with NaOH. After formation of the whole-cell configuration of the patch clamp, the cell was lifted off the dish bottom by moving the patch pipette and manually positioned in front of a gravity-driven microperfusion array under electronic control (BioLogique). Combined sodium and potassium currents were evoked every 5 seconds by a 20 ms test depolarization to 0 mV delivered from a holding potential of −90 mV. [Ala5]GpTx-1 (SEQ ID NO:22; 500 nM) peptide was added by switching perfusion tubes, and while fast sodium currents (presumably tetrodotoxin-sensitive, encoded at least partially by Nav1.7) steadily decreased, reflecting block by peptide, there was no change in the outward potassium currents. Currents shown in FIG. 94 are not leak-subtracted, but as the test pulse was to 0 mV, contamination by leak currents should be minimal. The results shown in FIG. 94 demonstrate that 500 nM [Ala5] GpTx-1 (SEQ ID NO:22) did not block voltage-gated potassium currents.

TABLE 6

Electrophysiology by IonWorks ® Quattro patch clamp system: comparison of GpTx-1 (SEQ ID NO: 1) and other toxins from *Grammostola porteri*.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 467 | {H}-DCLGFMRKCSPDNDKCCRPNLVCSRKHKWCKYEI-{Amide} | GpTx-2(1-34) | 4.34 | 7.21 | 11.73 | 1.15 | 2.7 | 10.2 | 3.8 |
| 468 | {H}-DCLGWFKGCDPDNDKCCEGYKCNRRDKWCKYKL-{Amide} | GpTx-3(1-33) | 8.93 | 7.80 | 20.00 | 9.37 | 2.2 | 2.1 | 1.0 |
| 469 | {H}-DCLGWFKGCDPDNDKCCENYKCNRREQWCKYKL-{Amide} | GpTx-4(1-33) | 9.25 | 10.38 | 11.00 | 4.92 | 1.2 | 2.2 | 1.9 |
| 473 | {H}-DCLGWFKGCDPDNDKCCENYKCNRRDKWC KYKLWK-{FreeAcid} | GpTx-7(1-35) | 10.4 | 7.6 | 10.0 | 3.5 | 1.0 | 2.8 | 2.9 |
| 474 | {H}-DCLGWFKGCDPDNDKCCENYKCNRRDKWCKYKLW-{FreeAcid} | GpTx-7(1-34) | 4.0 | 7.9 | 10.5 | 1.4 | 2.6 | 7.7 | 2.9 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |

TABLE 7

Electrophysiology by IonWorks ® Quattro patch clamp system: Position 0 additions relative to GpTx-1 (SEQ ID NO: 1) and Ac-GpTx-1 (SEQ ID NO: 132).

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 100 | {H}-ADCLGFMRKCIPDNDKCCRPNLVCSRTHKWCK YVF-{Amide} | Ala-GpTx-1(1-34) | 0.37 | 19.58 | 7.07 | 0.32 | 19.2 | 21.9 | 1.1 |
| 17 | {H}-EDCLGFMRKCIPDNDKCCRPNLVCSRTHKWCK YVF-{Amide} | Glu-GpTx-1(1-34) | 0.26 | 12.77 | 3.63 | 0.19 | 13.9 | 18.7 | 1.3 |
| 36 | {H}-KDCLGFMRKCIPDNDKCCRPNLVCSRTHKWCK YVF-{Amide} | Lys-GpTx-1(1-34) | 0.11 | 8.35 | 2.38 | 0.10 | 20.8 | 23.6 | 1.1 |
| 61 | {H}-RDCLGFMRKCIPDNDKCCRPNLVCSRTHKWC KYVF-{Amide} | Arg-GpTx-1(1-34) | 0.17 | 15.08 | 2.58 | 0.08 | 15.6 | 31.8 | 2.0 |
| 106 | {H}-WDCLGFMRKCIPDNDKCCRPNLVCSRTHKWCK YVF-{Amide} | Trp-GpTx-1(1-34) | 0.22 | 21.96 | 3.83 | 0.25 | 17.5 | 15.1 | 0.9 |
| 201 | {H}-[1-Nal]DCLGFMRKCIPDNDKCCRPNLVCSRT HKWCKYVF-{Amide} | 1-Nal-GpTx-1(1-34) | | | | | | | |
| 132 | {Acetyl}DCLGFMRKCIPDNDKCCRPNLVCSRTH KWCKYVF-{Amide} | Ac-GpTx-1(1-34) | 0.31 | 12.69 | 2.86 | 0.22 | 9.3 | 12.9 | 1.4 |
| 1 | {H}-DCLGFMRKCIPDNDKCCRPNLVCSRTHKWCK YVF-{Amide} | GpTx-1(1-34) | 0.08 | 13.09 | 1.93 | 0.08 | 24.9 | 22.8 | 0.9 |

TABLE 8

Electrophysiology by IonWorks ® Quattro patch clamp system Position 1 substitutions or deletions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 20 | {H}-ACLGFMRKCIPDNDKCCRPNLVCSRTHKWCK YVF-{Amide} | [Ala1]GpTx-1(1-34) | 0.10 | 9.86 | 1.68 | 0.08 | 16.8 | 21.1 | 1.3 |
| 18 | {H}-ECLGFMRKCIPDNDKCCRPNLVCSRTHKWCK YVF-{Amide} | [Glu1]GpTx-1(1-34) | 0.22 | 14.16 | 3.46 | 0.15 | 15.7 | 23.2 | 1.5 |
| 37 | {H}-KCLGFMRKCIPDNDKCCRPNLVCSRTHKWCK YVF-{Amide} | [Lys1]GpTx-1(1-34) | 0.15 | 7.29 | 1.49 | 0.07 | 10.2 | 21.0 | 2.1 |
| 62 | {H}-RCLGFMRKCIPDNDKCCRPNLVCSRTHKWCK YVF-{Amide} | [Arg1]GpTx-1(1-34) | 0.11 | 8.78 | 1.45 | 0.10 | 12.9 | 15.2 | 1.2 |
| 81 | {H}-WCLGFMRKCIPDNDKCCRPNLVCSRTHKWCK YVF-{Amide} | [Trp1]GpTx-1(1-34) | 0.05 | 8.79 | 3.06 | 0.10 | 56.1 | 30.9 | 0.6 |
| 77 | {H}-[1-Nal]CLGFMRKCIPDNDKCCRPNLVCSR THKWCKYVF-{Amide} | [1-Nal1]GpTx-1(1-34) | 0.11 | 13.38 | 6.77 | 0.14 | 62.9 | 48.0 | 0.8 |
| 97 | {H}-YCLGFMRKCIPDNDKCCRPNLVCSRTHKWCK YVF-{Amide} | [Tyr1]GpTx-1(1-34) | 0.16 | 10.61 | 3.89 | 0.13 | 24.5 | 29.0 | 1.2 |
| 108 | {H}-CLGFMRKCIPDNDKCCRPNLVCSRTHKWCK YVF-{Amide} | GpTx-1(2-34) | 0.07 | 8.22 | 1.10 | 0.05 | 14.8 | 20.3 | 1.4 |
| 188 | {H}-[PE]CLGFMRKCIPDNDKCCRPNLVCSRTHK WCKYVF-{Amide} | [PE1]GpTx-1(1-34) | 0.17 | 10.69 | 2.64 | 0.11 | 15.7 | 24.2 | 1.5 |
| 189 | {H}-ICLGFMRKCIPDNDKCCRPNLVCSRTHKWCK YVF-{Amide} | [Ile1]GpTx-1(1-34) | 0.10 | 8.15 | 1.34 | 0.07 | 13.1 | 20.3 | 1.5 |
| 190 | {H}-PCLGFMRKCIPDNDKCCRPNLVCSRTHKWC KYVF-{Amide} | [Pro1]GpTx-1(1-34) | 0.09 | 9.73 | 1.19 | 0.04 | 13.7 | 29.4 | 2.2 |
| 191 | {H}-SCLGFMRKCIPDNDKCCRPNLVCSRTHKWC KYVF-{Amide} | [Ser1]GpTx-1(1-34) | 0.07 | 9.40 | 1.14 | 0.05 | 15.7 | 21.2 | 1.4 |

TABLE 8-continued

Electrophysiology by IonWorks ® Quattro patch clamp system Position 1 substitutions or deletions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 192 | {H}-TCLGFMRKCIPDNDKCCRPNLVCSRTHKWCK VF-{Amide} | [Thr1]GpTx-1(1-34) | 0.11 | 9.21 | 1.41 | 0.07 | 12.5 | 20.5 | 1.6 |
| 1 | {H}-DCLGFMRKCIPDNDKCCRPNLVCSRTHKWCKY YVF-{Amide} | GpTx-1(1-34) | 0.08 | 13.09 | 1.93 | 0.08 | 24.9 | 22.8 | 0.9 |

TABLE 9

Electrophysiology by IonWorks ® Quattro patch clamp system: Position 3 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav 1.3 (μM) | Nav1.4/ Nav1.7 | Nav1.4/ Nav1.3 | Nav1.7/ Nav1.3 |
|---|---|---|---|---|---|---|---|---|---|
| 21 | {H}-DCAGFMRKCIPDNDKCCRPNLVCSRTHKWCKYVF-{Amide} | [Ala3]GpTx-1(1-34) | 0.51 | 19.01 | 14.46 | 0.10 | 28.2 | 138.2 | 4.9 |
| 19 | {H}-DCEGFMRKCIPDNDKCCRPNLVCSRTHKWCKYVF-{Amide} | [Glu3]GpTx-1(1-34) | 0.67 | 10.47 | 8.34 | 0.83 | 12.5 | 10.0 | 0.8 |
| 38 | {H}-DCKGFMRKCIPDNDKCCRPNLVCSRTHKWCKYVF-{Amide} | [Lys3]GpTx-1(1-34) | 0.08 | 6.95 | 1.87 | 0.06 | 23.0 | 33.1 | 1.4 |
| 155 | {H}-DCRGFMRKCIPDNDKCCRPNLVCSRTHKWCKYVF-{Amide} | [Arg3]GpTx-1(1-34) | 0.03 | 8.45 | 0.85 | 0.05 | 26.7 | 16.0 | 0.6 |
| 98 | {H}-DCQGFMRKCIPDNDKCCRPNLVCSRTHKWCKYVF-{Amide} | [Gln3]GpTx-1(1-34) | 0.25 | 16.40 | 5.25 | 0.24 | 20.7 | 21.5 | 1.0 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |

TABLE 10

Electrophysiology by IonWorks ® Quattro patch clamp system: Position 4 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 141 | {H}-DCLAFMRKCIPDNDKCCRPNLVCSRTHKWCKY VF-{Amide} | [Ala4]GpTx-1(1-34) | 0.27 | 11.30 | 3.24 | 0.21 | 12.0 | 15.4 | 1.3 |
| 24 | {H}-DCLEFMRKCIPDNDKCCRPNLVCSRTHKWCK YVF-{Amide} | [Glu4]GpTx-1(1-34) | 1.74 | 17.61 | 8.50 | 1.33 | 4.9 | 6.4 | 1.3 |
| 39 | {H}-DCLKFMRKCIPDNDKCCRPNLVCSRTHKWCK YVF-{Amide} | [Lys4]GpTx-1(1-34) | 0.20 | 9.82 | 6.49 | 0.18 | 32.7 | 36.2 | 1.1 |
| 63 | {H}-DCLRFMRKCIPDNDKCCRPNLVCSRTHKWCK YVF-{Amide} | [Arg4]GpTx-1(1-34) | 0.21 | 20.09 | 5.82 | 0.23 | 27.1 | 24.8 | 0.9 |
| 169 | {H}-DCLWFMRKCIPDNDKCCRPNLVCSRTHKWCK YVF-{Amide} | [Trp4]GpTx-1(1-34) | 0.05 | 10.33 | 0.52 | 0.03 | 10.0 | 19.3 | 1.9 |
| 160 | {H}-DCL[1-Nal]FMRKCIPDNDKCCRPNLVCS RTHKWCKYVF-{Amide} | [1-Nal4]GpTx-1(1-34) | 0.04 | 5.09 | 0.50 | 0.03 | 13.7 | 18.9 | 1.4 |

TABLE 10-continued

Electrophysiology by IonWorks ® Quattro patch clamp system: Position 4 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 1 | {H}-DCLGFMRKCIPDNDKCCRPNLVCSRTHKWCK YVF-{Amide} | GpTx-1(1-34) | 0.08 | 13.09 | 1.93 | 0.08 | 24.9 | 22.8 | 0.9 |

TABLE 11

Electrophysiology by IonWorks ® Quattro patch clamp system: Position 5 substitutions relative to SEQ ID NO: 1.

| SEQ ID NO. | Amino Acid Sequence | Designation | IWQ Use Nav1. 7 (μM) | IWQ Use Nav1. 5 (μM) | IWQ Use Nav1. 4 (μM) | IWQ Use Nav1. 3 (μM) | Nav1.4/ Nav1.7 | Nav1.4/ Nav1.3 | Nav1.7/ Nav1.3 |
|---|---|---|---|---|---|---|---|---|---|
| 22 | {H}-DCLGAMRKCIPDNDKCCRPNLVCSRTH KWCKYVF-{Amide} | [Ala5]GpTx-1(1-34) | 0.64 | 10.34 | 11.07 | 1.75 | 17.4 | 6.3 | 0.4 |
| 143 | {H}-DCLGEMRKCIPDNDKCCRPNLVCSRTH KWCKYVF-{Amide} | [Glu5]GpTx-1(1-34) | 17.67 | 10.01 | 22.26 | 22.29 | 1.3 | 1.0 | 0.8 |
| 156 | {H}-DCLGRMRKCIPDNDKCCRPNLVCSRTH KWCKYVF-{Amide} | [Arg5]GpTx-1(1-34) | 3.63 | 12.64 | 25.69 | 4.09 | 7.1 | 6.3 | 0.9 |
| 82 | {H}-DCLGWMRKCIPDNDKCCRPNLVCSRTH KWCKYVF-{Amide} | [Trp5]GpTx-1(1-34) | 0.15 | 9.32 | 2.30 | 0.11 | 15.6 | 21.4 | 1.4 |
| 105 | {H}-DCLG[1-Nal]MRKCIPDND KCCRPNL VCSRTHKWCKYVF-{Amide} | [1-Nal5]GpTx-1(1-34) | 0.08 | 13.41 | 2.13 | 0.10 | 26.4 | 21.7 | 0.8 |
| 88 | {H}-DCLGIMRKCIPDNDKCCRPNLVCSRTH KWCKYVF-{Amide} | [Ile5]GpTx-1(1-34) | 0.36 | 6.65 | 10.78 | 0.62 | 30.0 | 17.3 | 0.6 |
| 128 | {H}-DCLG[2-Nal]MRKCIPDND KCCRPNL VCSRTHKWCKYVF-{Amide} | [2-Nal5]GpTx-1(1-34) | 0.11 | 6.11 | 0.94 | 0.05 | 8.2 | 17.3 | 2.1 |
| 242 | {H}-DCLG[Bip]MRKCIPDNDKCCRPNLV CSRTHKWCKYVF-{Amide} | [Bip5]GpTx-1(1-34) | 0.06 | 3.38 | 0.14 | — | 2.3 | — | — |
| 243 | {H}-DCLG[Cha]MRKCIPDNDKCCRPNL VCSRTHKWCKYVF-{Amide} | [Cha5]GpTx-1(1-34) | 0.01 | 6.99 | 0.64 | 0.02 | 47.6 | 34.8 | 0.7 |
| 247 | {H}-DCLG[pI-Phe]MRKCIPDNDKCCRPNLVCSRTHKWCK YVF-{Amide} | [pI-Phe5]GpTx-1(1-34) | 0.16 | 6.16 | 19.68 | 0.02 | 121.9 | 1152.0 | 9.4 |
| 264 | {H}-DCLG[1'NMeW]MRKCIPDNDKCCRPNLVCSR THKWCKYVF-{Amide} | [1'NMeW5]GpTx-1(1-34) | 0.09 | 8.17 | 2.81 | 0.09 | 32.9 | 30.5 | 0.9 |
| 265 | {H}-DCLGGMRKCIPDNDKCCRPNLVCSRTH KWCKYVF-{Amide} | [Gly5]GpTx-1(1-34) | 0.75 | 7.47 | 10.73 | 1.24 | 14.3 | 8.6 | 0.6 |
| 266 | {H}-DCLGHMRKCIPDNDKCCRPNLVCSRTH KWCKYVF-{Amide} | [His5]GpTx-1(1-34) | 4.74 | 6.62 | 14.86 | 8.37 | 3.1 | 1.8 | 0.6 |
| 267 | {H}-DCLGLMRKCIPDNDKCCRPNLVCSRTH KWCKYVF-{Amide} | [Leu5]GpTx-1(1-34) | 0.17 | 7.40 | 12.14 | 0.30 | 70.9 | 40.0 | 0.6 |
| 268 | {H}-DCLGMMRKCIPDNDKCCRPNLVCSRTH KWCKYVF-{Amide} | [Met5]GpTx-1(1-34) | 0.10 | 12.81 | 11.20 | 0.24 | 113.6 | 45.9 | 0.4 |
| 269 | {H}-DCLGPMRKCIPDNDKCCRPNLVCSRTH KWCKYVF-{Amide} | [Pro5]GpTx-1(1-34) | 1.17 | 6.61 | 11.40 | 1.73 | 9.7 | 6.6 | 0.7 |
| 270 | {H}-DCLGTMRKCIPDNDKCCRPNLVCSRTH KWCKYVF-{Amide} | [Thr5]GpTx-1(1-34) | 1.22 | 15.25 | 15.54 | 2.19 | 12.7 | 7.1 | 0.6 |
| 271 | {H}-DCLGYMRKCIPDNDKCCRPNLVCSRTH KWCKYVF-{Amide} | [Tyr5]GpTx-1(1-34) | 1.43 | 15.58 | 6.48 | 1.64 | 4.5 | 3.9 | 0.9 |

TABLE 11-continued

Electrophysiology by IonWorks ® Quattro patch clamp system: Position 5 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 272 | {H}-DCLGVMRKCIPDNDKCCRPNLVCSRTH KWCKYVF-{Amide} | [Val5]GpTx-1(1-34) | 0.71 | 13.22 | 13.88 | 1.03 | 19.7 | 13.5 | 0.7 |
| 273 | {H}-DCLGfMRKCIPIDNDKCCRPNLVCSRTH KWCKYVF-{Amide} | [D-Phe5]GpTx-1(1-34) | 1.23 | >5 | >5 | 3.00 | — | — | 0.4 |
| 274 | {H}-DCLG[NMeTrp]MRKCIPDNDKCCRPNLVCSR THKWCKYVF-{Amide} | [NMeTrp5]GpTx-1(1-34) | 0.19 | >5 | 2.40 | 0.15 | 12.8 | 16.3 | 1.3 |
| 275 | {H}-DCLG[Phg]MRKCIPDNDKCCRPNL VCSRTHKWCKYVF-{Amide} | [Phg5]GpTx-1(1-34) | 0.09 | >5 | 2.55 | 0.17 | 28.4 | 15.4 | 0.5 |
| 276 | {H}-DCLG[4CO2-F]MRKCIPDNDKCCRPNLVCSRTHKWCKY VF-{Amide} | [4CO2-F5]GpTx-1(1-34) | 15.96 | 8.12 | 21.45 | 5.42 | 1.3 | 4.0 | 2.9 |
| 277 | {H}-DCLG[2PAL]MRKCIPDNDKCCRPNLV CSRTHKWCKYVF-{Amide} | [2PAL5]GpTx-1(1-34) | 2.07 | 9.25 | 11.86 | 4.58 | 5.7 | 2.6 | 0.5 |
| 1 | {H}-DCLGFMRKCIPDNDKCCRPNLVCSRTH KWCKYVF-{Amide} | GpTx-1(1-34) | 0.08 | 13.09 | 1.93 | 0.08 | 24.9 | 22.8 | 0.9 |

TABLE 12

Electrophysiology by IonWorks ® Quattro patch clamp system: Position 6 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 23 | {H}-DCLGFARKCIPDNDKCCRPNLVCSRTH KWCKYVF-{Amide} | [Ala6]GpTx-1(1-34) | 0.51 | 17.38 | 3.71 | 0.21 | 7.3 | 17.5 | 2.4 |
| 144 | {H}-DCLGFERKCIPDNDKCCRPNLVCSRTH KWCKYVF-{Amide} | [Glu6]GpTx-1(1-34) | 3.51 | 9.39 | 22.42 | 20.36 | 6.4 | 1.1 | 0.2 |
| 154 | {H}-DCLGFKRKCIPDNDKCCRPNLVCSRTH KWCKYVF-{Amide} | [Lys6]GpTx-1(1-34) | 14.52 | 13.95 | 24.95 | 8.49 | 1.7 | 2.9 | 1.7 |
| 64 | {H}-DCLGFRRKCIPDNDKCCRPNLVCSRTH KWCKYVF-{Amide} | [Arg6]GpTx-1(1-34) | 6.98 | 17.59 | 14.74 | 5.90 | 2.1 | 2.5 | 1.2 |
| 170 | {H}-DCLGFWRKCIPDNDKCCRPNLVCSRTH KWCKYVF-{Amide} | [Trp6]GpTx-1(1-34) | 0.013 | 3.58 | 0.25 | 0.002 | 19.1 | 123.5 | 6.5 |
| 161 | {H}-DCLGF[1-Nal]RKCIPDNDKCCRPNLV CSRTHKWCKYVF-{Amide} | [1-Nal6]GpTx-1(1-34) | 0.007 | 2.34 | 0.27 | 0.006 | 39.3 | 43.8 | 1.1 |
| 89 | {H}-DCLGFFRKCIPDNDKCCRPNLVCSRTH KWCKYVF-{Amide} | [Phe6]GpTx-1(1-34) | 0.05 | 9.21 | 1.39 | 0.03 | 28.2 | 40.7 | 1.4 |
| 3 | {H}-DCLGF[SeMet]RKCIPDNDKCCRPNLV CSRTHKWCKYVF-{Amide} | [SeMet6]GpTx-1(1-34) | 0.10 | 13.89 | 2.25 | 0.10 | 23.5 | 22.6 | 1.0 |
| 123 | {H}-DCLGF[Nle]RKCIPDNDKCCRPNLV CSRTHKWCKYVF-{Amide} | [Nle6]GpTx-1(1-34) | 0.05 | 4.50 | 0.43 | 0.02 | 8.1 | 23.3 | 2.9 |
| 124 | {H}-DCLGF[2-Abu]RKCIPDNDKCCRPNL VCSRTHKWCKYVF-{Amide} | [2-Abu6]GpTx-1(1-34) | 0.11 | 10.59 | 2.09 | 0.10 | 18.6 | 21.3 | 1.1 |
| 244 | {H}-DCLGFLRKCIPDNDKCCRPNLVCSRTH KWCKYVF-{Amide} | [Leu6]GpTx-1(1-34) | 0.06 | 6.42 | 15.94 | 0.04 | 270.6 | 364.7 | 1.3 |
| 245 | {H}-DCLGF[Cha]RKCIPDNDKCCRPNLV CSRTHKWCKYVF-{Amide} | [Cha6]GpTx-1(1-34) | 0.02 | 2.37 | 0.10 | — | 6.3 | — | — |

TABLE 12-continued

Electrophysiology by IonWorks ® Quattro patch clamp system: Position 6 substitutions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 278 | {H}-DCLGFNRKCIPDNDKCCRPNLVCSRTH KWCKYVF-{Amide} | [Asn6]GpTx-1(1-34) | 6.89 | 10.27 | 21.16 | 6.28 | 3.1 | 3.4 | 1.1 |
| 279 | {H}-DCLGFQRKCIPDNDKCCRPNLVCSRTH KWCKYVF-{Amide} | [Gln6]GpTx-1(1-34) | 8.62 | 7.57 | 14.08 | 5.96 | 1.6 | 2.4 | 1.4 |
| 280 | {H}-DCLGFGRKCIPDNDKCCRPNLVCSRTH KWCKYVF-{Amide} | [Gly6]GpTx-1(1-34) | 0.18 | 8.20 | 2.89 | 0.14 | 15.7 | 20.5 | 1.3 |
| 281 | {H}-DCLGFHRKCIPDNDKCCRPNLVCSRTH KWCKYVF-{Amide} | [His6]GpTx-1(1-34) | 4.72 | 10.06 | 17.82 | 7.77 | 3.8 | 2.3 | 0.6 |
| 282 | {H}-DCLGFIRKCIPDNDKCCRPNLVCSRTH KWCKYVF-{Amide} | [Ile6]GpTx-1(1-34) | 0.07 | 8.63 | 1.19 | 0.06 | 16.6 | 18.9 | 1.1 |
| 283 | {H}-DCLGFPRKCIPDNDKCCRPNLVCSRTH KWCKYVF-{Amide} | [Pro6]GpTx-1(1-34) | 0.79 | 10.00 | 11.00 | 0.76 | 13.8 | 14.4 | 1.0 |
| 284 | {H}-DCLGFSRKCIPDNDKCCRPNLVCSRTH KWCKYVF-{Amide} | [Ser6]GpTx-1(1-34) | 1.02 | 16.94 | 21.30 | 0.71 | 20.8 | 30.1 | 1.4 |
| 285 | {H}-DCLGFTRKCIPDNDKCCRPNLVCSRTH KWCKYVF-{Amide} | [Thr6]GpTx-1(1-34) | 0.59 | 18.71 | 4.25 | 0.28 | 7.2 | 15.4 | 2.1 |
| 286 | {H}-DCLGFYRKCIPDNDKCCRPNLVCSRTH KWCKYVF-{Amide} | [Tyr6]GpTx-1(1-34) | 0.97 | 6.38 | 11.59 | 0.52 | 11.9 | 22.2 | 1.9 |
| 287 | {H}-DCLGFVRKCIPDNDKCCRPNLVCSRTH KWCKYVF-{Amide} | [Val6]GpTx-1(1-34) | 0.09 | 9.23 | 1.77 | 0.08 | 18.8 | 23.4 | 1.2 |
| 288 | {H}-DCLGF[Phg]RKCIPDNDKCCRPNLVC SRTHKWCKYVF-{Amide} | [Phg6]GpTx-1(1-34) | 0.15 | >5 | 2.88 | 0.09 | 19.5 | 32.2 | 1.7 |
| 289 | {H}-DCLGF[NMeTrp]RKCIPDNDKCCRPNL VCSRTHKWCKYVF-{Amide} | [NMeTrp6]GpTx-1(1-34) | 0.14 | 21.45 | 3.69 | 0.24 | 26.5 | 15.4 | 0.6 |
| 290 | {H}-DCLGF[NMePhe]RKCIPDNDKCCRPN LVCSRTHKWCKYVF-{Amide} | [NMePhe6]GpTx-1(1-34) | 0.24 | 10.56 | 2.59 | 0.14 | 10.7 | 18.8 | 1.8 |
| 291 | {H}-DCLGF[pl-Phe]RKCIPDNDKCCRPNL VCSRTHKWCKYVF-{Amide} | [pl-Phe6]GpTx-1(1-34) | 0.02 | 0.95 | 0.04 | — | 2.6 | — | — |
| 292 | {H}-DCLGF[1'NMeW]RKCIPDNDKCCRPN LVCSRTHKWCKYVF-{Amide} | [1'NMeW6]GpTx-1(1-34) | 0.04 | 5.66 | 0.42 | 0.03 | 10.2 | 16.6 | 1.6 |
| 293 | {H}-DCLGF[4CO2-F]RKCIPDNDKCCRPNL VCSRTHKWCKYVF-{Amide} | [4CO2-F6]GpTx-1(1-34) | 15.79 | 11.11 | 21.50 | 13.78 | 1.4 | 1.6 | 1.1 |
| 294 | {H}-DCLGF[2PAL]RKCIPDNDKCCRPNLV CSRTHKWCKYVF-{Amide} | [2PAL6]GpTx-1(1-34) | 0.37 | 9.11 | 7.04 | 0.09 | 18.8 | 75.3 | 4.0 |
| 1 | {H}-DCLGFMRKCIPDNDKCCRPNLVCSRTH KWCKYVF-{Amide} | GpTx-1(1-34) | 0.08 | 13.09 | 1.93 | 0.08 | 24.9 | 22.8 | 0.9 |

TABLE 13

Electrophysiology by IonWorks ® Quattro patch clamp system: Substitutions at position 7 or 8 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 43 | {H}-DCLGFMAKCIPDNDKCCRPNLVCSRTHKW CKYVF-{Amide} | [Ala7]GpTx-1(1-34) | 0.94 | 21.55 | 4.72 | 0.83 | 5.0 | 5.7 | 1.1 |
| 145 | {H}-DCLGFMEKCIPDNDKCCRPNLVCSRTHKW CKYVF-{Amide} | [Glu7]GpTx-1(1-34) | 0.88 | 19.11 | 20.15 | 1.68 | 22.9 | 12.0 | 0.5 |

TABLE 13-continued

Electrophysiology by IonWorks ® Quattro patch clamp system: Substitutions at position 7 or 8 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 40 | {H}-DCLGFMKKCIPDNDKCCRPNLVCSRTH KWCKYVF-{Amide} | [Lys7]GpTx-1(1-34) | 0.53 | 23.28 | 6.48 | 0.47 | 12.1 | 13.8 | 1.1 |
| 115 | {H}-DCLGFM[Cit]KCIPDNDKCCRPNLVCS RTHKWCKYVF-{Amide} | [Cit7]GpTx-1(1-34) | 0.63 | 14.37 | 6.52 | 0.56 | 10.3 | 11.7 | 1.1 |
| 295 | {H}-DCLGFM[K(Me2)]KCIPDNDKCCRP NLVCSRTHKWCKYVF-{Amide} | [K(Me2)7]GpTx-1(1-34) | 0.82 | 13.27 | 10.69 | 0.27 | 13.0 | 39.0 | 3.0 |
| 296 | {H}-DCLGFM[SDMA]KCIPDNDKCCRP NLVCSRTHKWCKYVF-{Amide} | [SDMA7]GpTx-1(1-34) | 0.24 | 10.34 | 4.89 | 0.12 | 20.2 | 39.2 | 1.9 |
| 44 | {H}-DCLGFMRACIPDNDKCCRPNLVCSRTH KWCKYVF-{Amide} | [Ala8]GpTx-1(1-34) | 0.49 | 16.77 | 4.73 | 0.41 | 9.6 | 11.4 | 1.2 |
| 25 | {H}-DCLGFMRECIPDNDKCCRPNLVCSRTH KWCKYVF-{Amide} | [Glu8]GpTx-1(1-34) | 1.70 | 24.85 | 13.46 | 1.36 | 7.9 | 9.9 | 1.2 |
| 65 | {H}-DCLGFMRRCIPDNDKCCRPNLVCSRTH KWCKYVF-{Amide} | [Arg8]GpTx-1(1-34) | 0.14 | 13.76 | 1.78 | 0.12 | 13.1 | 14.4 | 1.1 |
| 118 | {H}-DCLGFMRTCIPDNDKCCRPNLVCSRTH KWCKYVF-{Amide} | [Thr8]GpTx-1(1-34) | 0.35 | 9.86 | 6.13 | 0.15 | 17.4 | 41.3 | 2.4 |
| 297 | {H}-DCLGFMR[SDMA]CIPDNDKCCRP NLVCSRTHKWCKYVF-{Amide} | [SDMA8]GpTx-1(1-34) | 0.20 | 9.05 | 5.47 | 0.20 | 28.0 | 27.1 | 1.0 |
| 298 | {H}-DCLGFMR[K(Me2)]CIPDNDKCCRP NLVCSRTHKWCKYVF-{Amide} | [K(Me2)8]GpTx-1(1-34) | 0.19 | 9.46 | 4.43 | 0.18 | 23.1 | 25.2 | 1.1 |
| 1 | {H}-DCLGFMRKCIPDNDKCCRPNLVCSRTH KWCKYVF-{Amide} | GpTx-1(1-34) | 0.08 | 13.09 | 1.93 | 0.08 | 24.9 | 22.8 | 0.9 |

TABLE 14

Electrophysiology by IonWorks ® Quattro patch clamp system: Substitutions at position 10 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 45 | {H}-DCLGFMRKCAPDNDKCCRPNLVCSRTH KWCKYVF-{Amide} | [Ala10]GpTx-1(1-34) | 0.21 | 16.48 | 2.95 | 0.19 | 14.1 | 15.5 | 1.1 |
| 146 | {H}-DCLGFMRKCEPDNDKCCRPNLVCSRTH KWCKYVF-{Amide} | [Glu10]GpTx-1(1-34) | 0.09 | 9.55 | 4.47 | 0.15 | 50.9 | 29.8 | 0.6 |
| 41 | {H}-DCLGFMRKCKPDNDKCCRPNLVCSRTH KWCKYVF-{Amide} | [Lys10]GpTx-1(1-34) | 0.24 | 9.00 | 2.57 | 0.15 | 10.9 | 17.3 | 1.6 |
| 66 | {H}-DCLGFMRKCRPDNDKCCRPNLVCSRTH KWCKYVF-{Amide} | [Arg10]GpTx-1(1-34) | 0.16 | 15.24 | 0.89 | 0.11 | 5.4 | 8.0 | 1.5 |
| 83 | {H}-DCLGFMRKCWPDNDKCCRPNLVCSRTH KWCKYVF-{Amide}34) | [Trp10]GpTx-1(1- | 0.10 | 8.02 | 4.35 | 0.19 | 44.1 | 23.1 | 0.5 |
| 78 | {H}-DCLGFMRKC[1-Nal]PDNDKCCRPNLV CSRTHKWCKYVF-{Amide} | [1-Nal10]GpTx-1(1-34) | 0.15 | 10.03 | 9.02 | 0.21 | 58.3 | 42.9 | 0.7 |
| 90 | {H}-DCLGFMRKCNPDNDKCCRPNLVCSRTH KWCKYVF-{Amide} | [Asn10]GpTx-1(1-34) | 0.49 | 14.14 | 9.33 | 0.19 | 19.2 | 49.4 | 2.6 |
| 119 | {H}-DCLGFMRKCDPDNDKCCRPNLVCSRTH KWCKYVF-{Amide} | [Asp10]GpTx-1(1-34) | 0.22 | 11.34 | 8.36 | 0.16 | 37.4 | 52.9 | 1.4 |
| 299 | {H}-DCLGFMRKCYPDNDKCCRPNLVCSRTH KWCKYVF-{Amide} | [Tyr10]GpTx-1(1-34) | 0.14 | 5.41 | 0.96 | 0.07 | 6.7 | 14.5 | 2.2 |

TABLE 14-continued

Electrophysiology by IonWorks ® Quattro patch clamp system: Substitutions at position 10 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 300 | {H}-DCLGFMRKC[NMeTrp]PDNDKCCRPN LVCSRTHKWCKYVF-{Amide} | [NMeTrp10]GpTx-1(1-34) | 0.08 | 9.89 | 1.93 | 0.07 | 24.4 | 28.9 | 1.2 |
| 301 | {H}-DCLGFMRKCVPDNDKCCRPNLVCSRTH KWCKYVF-{Amide} | [Val10]GpTx-1(1-34) | 0.10 | 7.88 | 1.41 | 0.09 | 13.6 | 15.3 | 1.1 |
| 302 | {H}-DCLGFMRKCFPDNDKCCRPNLVCSRTH KWCKYVF-{Amide} | [Phe10]GpTx-1(1-34) | 0.11 | 5.33 | 1.08 | 0.08 | 9.7 | 12.8 | 1.3 |
| 303 | {H}-DCLGFMRKCLPDNDKCCRPNLVCSRTH KWCKYVF-{Amide} | [Leu10]GpTx-1(1-34) | 0.13 | 8.13 | 2.54 | 0.08 | 19.1 | 30.9 | 1.6 |
| 304 | {H}-DCLGFMRKCHPDNDKCCRPNLVCSRTH KWCKYVF-{Amide} | [His10]GpTx-1(1-34) | 0.05 | 6.36 | 0.69 | 0.03 | 15.0 | 20.8 | 1.4 |
| 305 | {H}-DCLGFMRKCSPDNDKCCRPNLVCSRTH KWCKYVF-{Amide} | [Ser10]GpTx-1(1-34) | 0.05 | 4.64 | 1.95 | 0.09 | 36.6 | 22.2 | 0.6 |
| 307 | {H}-DCLGFMRKCMPDNDKCCRPNLVCSRTH KWCKYVF-{Amide} | [Met10]GpTx-1(1-34) | 0.09 | 3.38 | 3.09 | 0.10 | 32.9 | 32.4 | 1.0 |
| 308 | {H}-DCLGFMRKCPPDNDKCCRPNLVCSRTH KWCKYVF-{Amide} | [Pro10]GpTx-1(1-34) | 0.40 | >5 | 1.19 | 0.24 | 3.0 | 5.0 | 1.7 |
| 309 | {H}-DCLGFMRKCTPDNDKCCRPNLVCSRTH KWCKYVF-{Amide} | [Thr10]GpTx-1(1-34) | 0.10 | >5 | 1.08 | 0.06 | 10.7 | 17.7 | 1.7 |
| 310 | {H}-DCLGFMRKC[4CO2-F]PDNDKCCRPNL VCSRTHKWCKYVF-{Amide} | [4CO2-F10]GpTx-1(1-34) | 0.28 | 6.87 | 3.94 | 0.23 | 14.2 | 17.3 | 1.2 |
| 311 | {H}-DCLGFMRKC[2PAL]PDNDKCCRPNLVC SRTHKWCKYVF-{Amide} | [2PAL10]GpTx-1(1-34) | 0.19 | 8.83 | 2.91 | 0.04 | 15.4 | 66.3 | 4.3 |
| 1 | {H}-DCLGFMRKCIPDNDKCCRPNLVCSRTH KWCKYVF-{Amide} | GPTx-1(1-34) | 0.08 | 13.09 | 1.93 | 0.08 | 24.9 | 22.8 | 0.9 |

TABLE 15

Electrophysiology by IonWorks ® Quattro patch clamp system: Substitutions at position 11 or 12 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 46 | {H}-DCLGFMRKCIADNDKCCRPNLVCSRTHKWC KYVF-{Amide} | [Ala11]GpTx-1(1-34) | 0.21 | 16.05 | 2.97 | 0.18 | 14.4 | 16.6 | 1.2 |
| 147 | {H}-DCLGFMRKCIEDNDKCCRPNLVCSRTHK WCKYVF-{Amide} | [Glu11]GpTx-1(1-34) | 0.22 | 15.61 | 6.64 | 0.21 | 30.7 | 32.0 | 1.0 |
| 171 | {H}-DCLGFMRKCIWDNDKCCRPNLVCSRTHKW CKYVF-{Amide} | [Trp11]GpTx-1(1-34) | 0.07 | 9.50 | 1.66 | 0.04 | 22.4 | 36.9 | 1.6 |
| 4 | {H}-DCLGFMRKCIPANDKCCRPNLVCSRTHKW CKYVF-{Amide} | [Ala12]GpTx-1(1-34) | 0.12 | 8.05 | 0.70 | 0.13 | 6.0 | 5.4 | 0.9 |
| 26 | {H}-DCLGFMRKCIPENDKCCRPNLVCSRTHK WCKYVF-{Amide} | [Glu12]GpTx-1(1-34) | 0.26 | 6.45 | 2.24 | 0.19 | 8.5 | 11.9 | 1.4 |
| 42 | {H}-DCLGFMRKCIPKNDKCCRPNLVCSRTHK WCKYVF-{Amide} | [Lys12]GpTx-1(1-34) | 0.12 | 6.51 | 0.53 | 0.09 | 4.5 | 5.8 | 1.3 |
| 67 | {H}-DCLGFMRKCIPRNDKCCRPNLVCSRTHKW CKYVF-{Amide} | [Arg12]GpTx-1(1-34) | 0.11 | 5.00 | 0.52 | 0.14 | 4.6 | 3.8 | 0.8 |

TABLE 15-continued

Electrophysiology by IonWorks ® Quattro patch clamp system: Substitutions at position 11 or 12 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 172 | {H}-DCLGFMRKCIPWNDKCCRPNLVCSRTHKW CKYVF-{Amide} | [Trp12]GpTx-1(1-34) | 0.05 | 8.04 | 0.49 | 0.04 | 10.4 | 12.7 | 1.2 |
| 162 | {H}-DCLGFMRKCIP[1-Nal]NDKCCRPNLVCS RTHKWCKYVF-{Amide} | [1-Nal12]GpTx-1(1-34) | 0.06 | 9.88 | 0.55 | 0.04 | 9.4 | 12.3 | 1.3 |
| 91 | {H}-DCLGFMRKCIPSNDKCCRPNLVCSRTHKWC KYVF-{Amide} | [Ser12]GpTx-1(1-34) | 0.08 | 9.58 | 1.68 | 0.19 | 20.5 | 8.9 | 0.4 |
| 194 | {H}-DCLGFMRKCIPGNDKCCRPNLVCSRTHKW CKYVF-{Amide} | [Gly12]GpTx-1(1-34) | 0.075 | 8.764 | 0.510 | 0.047 | 6.8 | 10.9 | 1.6 |
| 195 | {H}-DCLGFMRKCIPINDKCCRPNLVCSRTHKW CKYVF-{Amide} | [Ile12]GpTx-1(1-34) | 0.662 | 18.322 | 5.834 | 0.607 | 8.8 | 9.6 | 1.1 |
| 193 | {H}-DCLGFMRKCIPLNDKCCRPNLVCSRTHKWC KYVF-{Amide}1(1-34) | [Leu12]GpTx- | 0.080 | 6.832 | 0.586 | 0.071 | 7.4 | 8.2 | 1.1 |
| 196 | {H}-DCLGFMRKCIPTNDKCCRPNLVCSRTHKW CKYVF-{Amide} | [Thr12]GpTx-1(1-34) | 0.097 | 7.079 | 0.649 | 0.074 | 6.7 | 8.8 | 1.3 |
| 197 | {H}-DCLGFMRKCIPYNDKCCRPNLVCSRTHKWCK YVF-{Amide} | [Tyr12]GpTx-1(1-34) | 0.098 | 6.920 | 0.475 | 0.042 | 4.8 | 11.2 | 2.3 |
| 1 | {H}-DCLGFMRKCIPDNDKCCRPNLVCSRTHKWC KYVF-{Amide} | GpTx-1(1-34) | 0.08 | 13.09 | 1.93 | 0.08 | 24.9 | 22.8 | 0.9 |

TABLE 16

Electrophysiology by IonWorks ® Quattro patch clamp system: Substitutions at position 13 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 5 | {H}-DCLGFMRKCIPDADKCCRPNLVCSRTH KWCKYVF-{Amide} | [Ala13]GpTx-1(1-34) | 0.17 | 8.15 | 2.64 | 0.16 | 15.9 | 16.9 | 1.1 |
| 27 | {H}-DCLGFMRKCIPDEDKCCRPNLVCSRTH KWCKYVF-{Amide} | [Glu13]GpTx-1(1-34) | 0.26 | 9.38 | 4.41 | 0.22 | 17.2 | 19.8 | 1.2 |
| 48 | {H}-DCLGFMRKCIPDKDKCCRPNLVCSRTH KWCKYVF-{Amide} | [Lys13]GpTx-1(1-34) | 0.21 | 9.72 | 2.44 | 0.13 | 11.5 | 19.1 | 1.7 |
| 103 | {H}-DCLGFMRKCIPDRDKCCRPNLVCSRTH KWCKYVF-{Amide} | [Arg13]GpTx-1(1-34) | 0.16 | 15.96 | 4.64 | 0.22 | 29.4 | 21.4 | 0.7 |
| 173 | {H}-DCLGFMRKCIPDWDKCCRPNLVCSRTH KWCKYVF-{Amide} | [Trp13]GpTx-1(1-34) | 0.09 | 17.29 | 2.28 | 0.05 | 26.2 | 49.3 | 1.9 |
| 163 | {H}-DCLGFMRKCIPD[1-Nal]DKCCRPNLVCS RTHKWCKYVF-{Amide} | [1-Nal13]GpTx-1(1-34) | 0.11 | 8.27 | 2.84 | 0.09 | 24.9 | 32.4 | 1.3 |
| 1 | {H}-DCLGFMRKCIPDNDKCCRPNLVCSRTH KWCKYVF-{Amide} | GpTx-1(1-34) | 0.08 | 13.09 | 1.93 | 0.08 | 24.9 | 22.8 | 0.9 |

TABLE 17

Electrophysiology by IonWorks ® Quattro patch clamp system: Substitutions at position 15 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 6 | {H}-DCLGFMRKCIPDNDACCRPNLVCSRTH KWCKYVF-{Amide} | [Ala15]GpTx-1(1-34) | 0.22 | 9.64 | 4.68 | 0.19 | 21.5 | 24.2 | 1.1 |
| 28 | {H}-DCLGFMRKCIPDNDECCRPNLVCSRTH KWCKYVF-{Amide} | [Glu15]GpTx-1(1-34) | 0.59 | 12.09 | 8.75 | 0.49 | 14.8 | 17.8 | 1.2 |
| 68 | {H}-DCLGFMRKCIPDNDRCCRPNLVCSRTH KWCKYVF-{Amide} | [Arg15]GpTx-1(1-34) | 0.20 | 18.14 | 2.27 | 0.14 | 11.2 | 16.0 | 1.4 |
| 92 | {H}-DCLGFMRKCIPDNDQCCRPNLVCSRTH KWCKYVF-{Amide} | [Gln15]GpTx-1(1-34) | 0.13 | 7.60 | 2.42 | 0.12 | 19.3 | 20.9 | 1.1 |
| 312 | {H}-DCLGFMRKCIPDND[SDMA]CCRPNLVCSR THKWCKYVF-{Amide} | [SDMA15]GpTx-1(1-34) | 0.14 | 9.67 | 1.96 | 0.15 | 14.0 | 13.0 | 0.9 |
| 313 | {H}-DCLGFMRKCIPDND[K(Me2)]CCRPNLVC SRTHKWCKYVF-{Amide} | [K(Me2)15]GpTx-1(1-34) | 0.19 | 10.13 | 4.75 | 0.13 | 24.4 | 36.6 | 1.5 |
| 1 | {H}-DCLGFMRKCIPDNDKCCRPNLVCSRTH KWCKYVF-{Amide} | GpTx-1(1-34) | 0.08 | 13.09 | 1.93 | 0.08 | 24.9 | 22.8 | 0.9 |

TABLE 18

Electrophysiology by IonWorks ® Quattro patch clamp system: Substitutions at position 18 or 19 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.7 | Nav1.7/ Nav1.3 |
|---|---|---|---|---|---|---|---|---|---|
| 148 | {H}-DCLGFMRKCIPDNDKCCEPNLVCSRTH KWCKYVF-{Amide} | [Glu18]GpTx-1(1-34) | 0.22 | 14.60 | 4.95 | 0.21 | 22.8 | 23.7 | 1.0 |
| 49 | {H}-DCLGFMRKCIPDNDKCCKPNLVCSRTH KWCKYVF-{Amide} | [Lys18]GpTx-1(1-34) | 0.30 | 17.56 | 3.78 | 0.21 | 12.5 | 18.1 | 1.4 |
| 174 | {H}-DCLGFMRKCIPDNDKCCWPNLVCSRTH KWCKYVF-{Amide} | [Trp18]GpTx-1(1-34) | 0.19 | 14.73 | 8.66 | 0.08 | 46.6 | 108.0 | 2.3 |
| 116 | {H}-DCLGFMRKCIPDNDKCC[Cit]PNLV CSRTHKWCKYVF-{Amide} | [Cit18]GpTx-1(1-34) | 0.17 | 11.00 | 5.24 | 0.23 | 30.2 | 23.1 | 0.8 |
| 314 | {H}-DCLGFMRKCIPDNDKCC[K(Me2) ]PNLVCSRTHKWCKYVF-{Amide} | [K(Me2)18]GpTx-1(1-34) | 0.21 | 6.55 | 6.70 | 0.08 | 31.8 | 82.8 | 2.6 |
| 315 | {H}-DCLGFMRKCIPDNDKCC[SDMA ]PNLVCSRTHKWCKYVF-{Amide} | [SDMA18]GpTx-1(1-34) | 0.14 | 10.48 | 3.41 | 0.10 | 25.1 | 32.8 | 1.3 |
| 316 | {H}-DCLGFMRKCIPDNDKCC[2PAL ]PNLVCSRTHKWCKYVF-{Amide} | [2PAL18]GpTx-1(1-34) | 0.19 | 9.17 | 9.85 | 0.06 | 51.9 | 167.0 | 3.2 |
| 50 | {H}-DCLGFMRKCIPDNDKCCRKNLVCSR THKWCKYVF-{Amide} | [Lys19]GpTx-1(1-34) | 0.12 | 10.63 | 4.29 | 0.18 | 36.2 | 24.2 | 0.7 |
| 157 | {H}-DCLGFMRKCIPDNDKCCRRNLVCSR THKWCKYVF-{Amide} | [Arg19]GpTx-1(1-34) | 0.07 | 6.16 | 1.42 | 0.06 | 21.0 | 23.4 | 1.1 |
| 181 | {H}-DCLGFMRKCIPDNDKCCRSNLVCSR THKWCKYVF-{Amide} | [Ser19]GpTx-1(1-34) | 0.088 | 11.392 | 3.107 | 0.031 | 35.5 | 101.2 | 2.9 |
| 93 | {H}-DCLGFMRKCIPDNDKCCRSSNLVCSR THKWCKYVF-{Amide} | [Ser-Ser19]GpTx-1(1-34) | 0.27 | 13.92 | 6.67 | 0.32 | 24.3 | 20.6 | 0.8 |
| 126 | {H}-DCLGFMRKCIPDNDKCCRGNLVCSR THKWCKYVF-{Amide} | [Gly19]GpTx-1(1-34) | 0.10 | 11.92 | 1.82 | 0.11 | 18.6 | 17.2 | 0.9 |

TABLE 18-continued

Electrophysiology by IonWorks ® Quattro patch clamp system: Substitutions at position 18 or 19 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.7 | Nav1.7/ Nav1.3 |
|---|---|---|---|---|---|---|---|---|---|
| 1 | {H}-DCLGFMRKCIPDNDKCCRPNLVCSR THKWCKYVF-{Amide} | GpTx-1(1-34) | 0.08 | 13.09 | 1.93 | 0.08 | 24.9 | 22.8 | 0.9 |

TABLE 19

Electrophysiology by IonWorks ® Quattro patch clamp system: Substitutions at position 20 or 21 relative to SEQ ID NO: 1.

| SEQ ID NO. | Amino Acid Sequence | Designation |
|---|---|---|
| 7 | {H}-DCLGFMRKCIPDNDKCCRPALVCSRTHKWCKYVF-{Amide} | [Ala20]GpTx-1(1-34) |
| 149 | {H}-DCLGFMRKCIPDNDKCCRPELVCSRTHKWCKYVF-{Amide} | [Glu20]GpTx-1(1-34) |
| 51 | {H}-DCLGFMRKCIPDNDKCCRPKLVCSRTHKWCKYVF-{Amide} | [Lys20]GpTx-1(1-34) |
| 69 | {H}-DCLGFMRKCIPDNDKCCRPRLVCSRTHKWCKYVF-{Amide} | [Arg20]GpTx-1(1-34) |
| 175 | {H}-DCLGFMRKCIPDNDKCCRPWLVCSRTHKWCKYVF-{Amide} | [Trp20]GpTx-1(1-34) |
| 164 | {H}-DCLGFMRKCIPDNDKCCRP[1-Nal]LVCSRTHKWCKYVF-{Amide} | [1-Nal20]GpTx-1(1-34) |
| 200 | {H}-DCLGFMRKCIPDNDKCCRPYLVCSRTHKWCKYVF-{Amide} | [Tyr20]GpTx-1(1-34) |
| 198 | {H}-DCLGFMRKCIPDNDKCCRPGLVCSRTHKWCKYVF-{Amide} | [Gly20]GpTx-1(1-34) |
| 199 | {H}-DCLGFMRKCIPDNDKCCRPFLVCSRTHKWCKYVF-{Amide} | [Phe20]GpTx-1(1-34) |
| 176 | {H}-DCLGFMRKCIPDNDKCCRPNWVCSRTHKWCKYVF-{Amide} | [Trp21]GpTx-1(1-34) |
| 165 | {H}-DCLGFMRKCIPDNDKCCRPN[1-Nal]VCSRTHKWCKYVF-{Amide} | [1-Nal21]GpTx-1(1-34) |
| 120 | {H}-DCLGFMRKCIPDNDKCCRPNMVCSRTHKWCKYVF-{Amide} | [Met21]GpTx-1(1-34) |
| 317 | {H}-DCLGFMRKCIPDNDKCCRPN[4CO2-F]VCSRTHKWCKYVF-{Amide} | [4CO2-F21]GpTx-1(1-34) |
| 318 | {H}-DCLGFMRKCIPDNDKCCRPN[2PAL]VCSRTHKWCKYVF-{Amide} | [2PAL21]GpTx-1(1-34) |
| 1 | {H}-DCLGFMRKCIPDNDKCCRPNLVCSRTHKWCKYVF-{Amide} | GpTx-1(1-34) |

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|
| 7 | 0.69 | 19.53 | 7.13 | 0.41 | 10.4 | 17.5 | 1.7 |
| 149 | 1.42 | 7.49 | 20.92 | 1.02 | 14.7 | 20.6 | 1.4 |
| 51 | 0.61 | 18.96 | 3.72 | 0.33 | 6.1 | 11.4 | 1.9 |

TABLE 19-continued

| Electrophysiology by IonWorks ® Quattro patch clamp system: Substitutions at position 20 or 21 relative to SEQ ID NO: 1. | | | | | | | |
|---|---|---|---|---|---|---|---|
| 69 | 0.17 | 14.91 | 1.42 | 0.08 | 8.5 | 17.8 | 2.1 |
| 175 | 0.05 | 7.39 | 0.85 | 0.02 | 16.7 | 37.6 | 2.3 |
| 164 | 0.07 | 7.36 | 0.42 | 0.06 | 5.7 | 6.4 | 1.1 |
| 200 | 0.116 | 9.054 | 1.145 | 0.055 | 9.8 | 20.8 | 2.1 |
| 198 | 0.229 | 9.754 | 2.629 | 0.126 | 11.5 | 20.9 | 1.8 |
| 199 | 0.154 | 10.787 | 1.837 | 0.067 | 12.0 | 27.4 | 2.3 |
| 176 | 0.10 | 13.75 | 2.65 | 0.05 | 26.8 | 48.6 | 1.8 |
| 165 | 0.08 | 10.63 | 3.17 | 0.09 | 38.9 | 35.5 | 0.9 |
| 120 | 0.14 | 9.54 | 1.79 | 0.09 | 12.9 | 19.3 | 1.5 |
| 317 | 3.98 | 8.90 | 19.74 | 3.67 | 5.0 | 5.4 | 1.1 |
| 318 | 0.18 | 7.52 | 3.48 | 0.08 | 19.8 | 41.6 | 2.1 |
| 1 | 0.08 | 13.09 | 1.93 | 0.08 | 24.9 | 22.8 | 0.9 |

TABLE 20

Electrophysiology by IonWorks ® Quattro patch clamp system: Substitutions at position 22 relative to SEQ ID NO: 1.

| SEQ ID NO. | Amino Acid Sequence | Designation |
|---|---|---|
| 8 | {H}-DCLGFMRKCIPDNDKCCRPNLACSRTHKWCKYVF-{Amide} | [Ala22]GpTx-1(1-34) |
| 102 | {H}-DCLGFMRKCIPDNDKCCRPNLECSRTHKWCKYVF-{Amide} | [Glu22]GpTx-1(1-34) |
| 52 | {H}-DCLGFMRKCIPDNDKCCRPNLKCSRTHKWCKYVF-{Amide} | [Lys22]GpTx-1(1-34) |
| 158 | {H}-DCLGFMRKCIPDNDKCCRPNLRCSRTHKWCKYVF-{Amide} | [Arg22]GpTx-1(1-34) |
| 177 | {H}-DCLGFMRKCIPDNDKCCRPNLWCSRTHKWCKYVF-{Amide} | [Trp22]GpTx-1(1-34) |
| 319 | {H}-DCLGFMRKCIPDNDKCCRPNLFCSRTHKWCKYVF-{Amide} | [Phe22]GpTx-1(1-34) |
| 320 | {H}-DCLGFMRKCIPDNDKCCRPNLPCSRTHKWCKYVF-{Amide} | [Pro22]GpTx-1(1-34) |
| 321 | {H}-DCLGFMRKCIPDNDKCCRPNLICSRTHKWCKYVF-{Amide} | [Ile22]GpTx-1(1-34) |
| 322 | {H}-DCLGFMRKCIPDNDKCCRPNLLCSRTHKWCKYVF-{Amide} | [Leu22]GpTx-1(1-34) |
| 323 | {H}-DCLGFMRKCIPDNDKCCRPNLSCSRTHKWCKYVF-{Amide} | [Ser22]GpTx-1(1-34) |
| 324 | {H}-DCLGFMRKCIPDNDKCCRPNLGCSRTHKWCKYVF-{Amide} | [Gly22]GpTx-1(1-34) |
| 325 | {H}-DCLGFMRKCIPDNDKCCRPNLNCSRTHKWCKYVF-{Amide} | [Asn22]GpTx-1(1-34) |
| 326 | {H}-DCLGFMRKCIPDNDKCCRPNLHCSRTHKWCKYVF-{Amide} | [His22]GpTx-1(1-34) |
| 327 | {H}-DCLGFMRKCIPDNDKCCRPNLDCSRTHKWCKYVF-{Amide} | [Asp22]GpTx-1(1-34) |

TABLE 20-continued

Electrophysiology by IonWorks ® Quattro patch clamp system: Substitutions at position 22 relative to SEQ ID NO: 1.

| | | |
|---|---|---|
| 328 | {H}-DCLGFMRKCIPDNDKCCRPNL[NMePhe]CSRTHKWCKYVF-{Amide} | [NMePhe22]GpTx-1(1-34) |
| 329 | {H}-DCLGFMRKCIPDNDKCCRPNLTCSRTHKWCKYVF-{Amide} | [Thr22]GpTx-1(1-34) |
| 330 | {H}-DCLGFMRKCIPDNDKCCRPNL[Phg]CSRTHKWCKYVF-{Amide} | [Phg22]GpTx-1(1-34) |
| 331 | {H}-DCLGFMRKCIPDNDKCCRPNLYCSRTHKWCKYVF-{Amide} | [Tyr22]GpTx-1(1-34) |
| 332 | {H}-DCLGFMRKCIPDNDKCCRPNLMCSRTHKWCKYVF-{Amide} | [Met22]GpTx-1(1-34) |
| 333 | {H}-DCLGFMRKCIPDNDKCCRPNL[4CO2-F]CSRTHKWCKYVF-{Amide} | [4CO2-F22]GpTx-1(1-34) |
| 334 | {H}-DCLGFMRKCIPDNDKCCRPNL[2PAL]CSRTHKWCKYVF-{Amide} | [2PAL22]GpTx-1(1-34) |
| 1 | {H}-DCLGFMRKCIPDNDKCCRPNLVCSRTHKWCKYVF-{Amide} | GpTx-1(1-34) |

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/Nav1.3 | Nav1.7/Nav1.3 |
|---|---|---|---|---|---|---|---|
| 8 | 0.38 | 20.43 | 13.76 | 0.32 | 36.1 | 43.2 | 1.2 |
| 102 | 1.40 | 20.78 | 8.31 | 2.14 | 6.0 | 3.9 | 0.7 |
| 52 | 0.19 | 15.03 | 1.96 | 0.08 | 10.4 | 25.7 | 2.5 |
| 158 | 0.06 | 8.20 | 0.70 | 0.03 | 11.7 | 24.3 | 2.1 |
| 177 | 0.03 | 8.02 | 4.23 | 0.06 | 137.2 | 75.1 | 0.5 |
| 319 | 0.70 | >5 | >5 | 1.02 | — | — | 0.7 |
| 320 | >5 | >5 | >5 | >5 | — | — | — |
| 321 | 0.08 | 11.51 | 1.54 | 0.07 | 19.3 | 20.6 | 1.1 |
| 322 | 0.09 | 9.58 | 0.83 | 0.07 | 9.3 | 11.4 | 1.2 |
| 323 | 0.10 | 4.42 | 1.44 | 0.09 | 14.7 | 16.1 | 1.1 |
| 324 | 0.14 | 10.86 | 4.66 | 0.10 | 33.5 | 45.2 | 1.4 |
| 325 | 0.24 | 8.07 | 1.78 | 0.09 | 7.5 | 19.3 | 2.6 |
| 326 | 0.41 | 15.64 | 2.51 | 0.10 | 6.0 | 24.1 | 4.0 |
| 327 | 1.50 | 13.26 | 7.31 | 0.63 | 4.9 | 11.7 | 2.4 |
| 328 | 20.60 | 20.39 | 18.40 | 7.37 | 0.9 | 2.5 | 2.8 |
| 329 | 0.12 | 4.59 | 1.38 | 0.08 | 11.3 | 18.2 | 1.6 |
| 330 | 0.18 | 4.69 | 1.82 | 0.07 | 10.0 | 25.0 | 2.5 |
| 331 | 0.56 | 4.26 | 7.91 | 0.50 | 14.1 | 15.9 | 1.1 |
| 332 | 0.09 | 4.61 | 0.43 | 0.08 | 4.9 | 5.5 | 1.1 |
| 333 | 5.77 | 7.50 | 22.51 | 4.47 | 3.9 | 5.0 | 1.3 |
| 334 | 0.33 | 10.96 | 6.80 | 0.14 | 20.5 | 49.4 | 2.4 |
| 1 | 0.08 | 13.09 | 1.93 | 0.08 | 24.9 | 22.8 | 0.9 |

TABLE 21

Electrophysiology by IonWorks ® Quattro patch clamp system: Substitutions at position 24 or 25 relative to SEQ ID NO: 1.

| SEQ ID NO. | Amino Acid Sequence | Designation |
|---|---|---|
| 142 | {H}-DCLGFMRKCIPDNDKCCRPNLVCARTHKWCKYVF-{Amide} | [Ala24]GpTx-1(1-34) |
| 150 | {H}-DCLGFMRKCIPDNDKCCRPNLVCERTHKWCKYVF-{Amide} | [Glu24]GpTx-1(1-34) |
| 9 | {H}-DCLGFMRKCIPDNDKCCRPNLVCSATHKWCKYVF-{Amide} | [Ala25]GpTx-1(1-34) |
| 151 | {H}-DCLGFMRKCIPDNDKCCRPNLVCSETHKWCKYVF-{Amide} | [Glu25]GpTx-1(1-34) |
| 53 | {H}-DCLGFMRKCIPDNDKCCRPNLVCSKTHKWCKYVF-{Amide} | [Lys25]GpTx-1(1-34) |
| 117 | {H}-DCLGFMRKCIPDNDKCCRPNLVCS[Cit]THKWCKYVF-{Amide} | [Cit25]GpTx-1(1-34) |
| 335 | {H}-DCLGFMRKCIPDNDKCCRPNLVCS[K(Me2)]THKWCKYVF-{Amide} | [K(Me2)25]GpTx-1(1-34) |
| 336 | {H}-DCLGFMRKCIPDNDKCCRPNLVCS[SDMA]THKWCKYVF-{Amide} | [SDMA25]GpTx-1(1-34) |
| 1 | {H}-DCLGFMRKCIPDNDKCCRPNLVCSRTHKWCKYVF-{Amide} | GpTx-1(1-34) |

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|
| 142 | 0.47 | 8.20 | 1.93 | 0.25 | 4.1 | 7.8 | 1.9 |
| 150 | 6.12 | 11.48 | 23.12 | 6.78 | 3.8 | 3.4 | 0.9 |
| 9 | 0.30 | 18.78 | 6.19 | 0.84 | 20.8 | 7.3 | 0.4 |
| 151 | 0.71 | 13.99 | 16.27 | 1.17 | 22.8 | 13.9 | 0.6 |
| 53 | 0.38 | 15.21 | 3.89 | 0.24 | 10.4 | 16.2 | 1.6 |
| 117 | 0.32 | 8.87 | 10.49 | 0.51 | 32.3 | 20.6 | 0.6 |
| 335 | 0.31 | 7.93 | 13.57 | 0.11 | 43.2 | 126.4 | 2.9 |
| 336 | 0.14 | 9.22 | 2.68 | 0.11 | 19.8 | 23.5 | 1.2 |
| 1 | 0.08 | 13.09 | 1.93 | 0.08 | 24.9 | 22.8 | 0.9 |

TABLE 22

Electrophysiology by IonWorks ® Quattro patch clamp system: Substitutions at position 26 relative to SEQ ID NO: 1.

| SEQ ID NO. | Amino Acid Sequence | Designation |
|---|---|---|
| 10 | {H}-DCLGFMRKCIPDNDKCCRPNLVCSRAHKWCKYVF-{Amide} | [Ala26]GpTx-1(1-34) |
| 152 | {H}-DCLGFMRKCIPDNDKCCRPNLVCSREHKWCKYVF-{Amide} | [Glu26]GpTx-1(1-34) |
| 54 | {H}-DCLGFMRKCIPDNDKCCRPNLVCSRKHKWCKYVF-{Amide} | [Lys26]GpTx-1(1-34) |

TABLE 22-continued

Electrophysiology by IonWorks ® Quattro patch clamp system: Substitutions at position 26 relative to SEQ ID NO: 1.

| | | |
|---|---|---|
| 70 | {H}-DCLGFMRKCIPDNDKCCRPNLVCSRRHKWCKYVF-{Amide} | [Arg26]GpTx-1(1-34) |
| 178 | {H}-DCLGFMRKCIPDNDKCCRPNLVCSRWHKWCKYVF-{Amide} | [Trp26]GpTx-1(1-34) |
| 94 | {H}-DCLGFMRKCIPDNDKCCRPNLVCSRKTKWCKYVF-{Amide} | [Lys26;Thr27]GpTx-1(1-34) |
| 121 | {H}-DCLGFMRKCIPDNDKCCRPNLVCSRLHKWCKYVF-{Amide} | [Leu26]GpTx-1(1-34) |
| 337 | {H}-DCLGFMRKCIPDNDKCCRPNLVCSRHHKWCKYVF-{Amide} | [His26]GpTx-1(1-34) |
| 338 | {H}-DCLGFMRKCIPDNDKCCRPNLVCSRSHKWCKYVF-{Amide} | [Ser26]GpTx-1(1-34) |
| 339 | {H}-DCLGFMRKCIPDNDKCCRPNLVCSRQHKWCKYVF-{Amide} | [Gln26]GpTx-1(1-34) |
| 340 | {H}-DCLGFMRKCIPDNDKCCRPNLVCSRYHKWCKYVF-{Amide} | [Tyr26]GpTx-1(1-34) |
| 341 | {H}-DCLGFMRKCIPDNDKCCRPNLVCSRFHKWCKYVF-{Amide} | [Phe26]GpTx-1(1-34) |
| 342 | {H}-DCLGFMRKCIPDNDKCCRPNLVCSRNHKWCKYVF-{Amide} | [Asn26]GpTx-1(1-34) |
| 343 | {H}-DCLGFMRKCIPDNDKCCRPNLVCSRGHKWCKYVF-{Amide} | [Gly26]GpTx-1(1-34) |
| 344 | {H}-DCLGFMRKCIPDNDKCCRPNLVCSRVHKWCKYVF-{Amide} | [Val26]GpTx-1(1-34) |
| 345 | {H}-DCLGFMRKCIPDNDKCCRPNLVCSRPHKWCKYVF-{Amide} | [Pro26]GpTx-1(1-34) |
| 346 | {H}-DCLGFMRKCIPDNDKCCRPNLVCSRMHKWCKYVF-{Amide} | [Met26]GpTx-1(1-34) |
| 347 | {H}-DCLGFMRKCIPDNDKCCRPNLVCSRDHKWCKYVF-{Amide} | [Asp26]GpTx-1(1-34) |
| 348 | {H}-DCLGFMRKCIPDNDKCCRPNLVCSRIHKWCKYVF-{Amide} | [Ile26]GpTx-1(1-34) |
| 349 | {H}-DCLGFMRKCIPDNDKCCRPNLVCSR[2PAL]HKWCKYVF-{Amide} | [2PAL26]GpTx-1(1-34) |
| 350 | {H}-DCLGFMRKCIPDNDKCCRPNLVCSR[4CO2-F]HKWCKYVF-{Amide} | [4CO2-F26]GpTx-1(1-34) |
| 1 | {H}-DCLGFMRKCIPDNDKCCRPNLVCSRTHKWCKYVF-{Amide} | GpTx-1(1-34) |

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|
| 10 | 0.25 | 10.45 | 3.16 | 0.17 | 12.5 | 18.2 | 1.5 |
| 152 | 0.68 | 17.15 | 23.59 | 0.71 | 34.5 | 33.5 | 1.0 |
| 54 | 0.05 | 7.96 | 0.75 | 0.02 | 14.5 | 43.0 | 3.0 |
| 70 | 0.03 | 3.06 | 0.53 | 0.008 | 15.5 | 68.3 | 4.4 |
| 178 | 0.03 | 5.84 | 0.63 | 0.02 | 19.7 | 27.4 | 1.4 |

TABLE 22-continued

Electrophysiology by IonWorks ® Quattro patch clamp system: Substitutions at position 26 relative to SEQ ID NO: 1.

| | | | | | | | |
|---|---|---|---|---|---|---|---|
| 94 | 0.10 | 9.29 | 3.52 | 0.05 | 36.2 | 65.7 | 1.8 |
| 121 | 0.07 | 10.20 | 3.45 | 0.07 | 51.9 | 46.8 | 0.9 |
| 337 | 0.10 | 4.52 | 10.31 | 0.08 | 100.6 | 124.4 | 1.2 |
| 338 | 0.10 | 12.32 | 1.12 | 0.09 | 11.2 | 12.9 | 1.2 |
| 339 | 0.14 | 17.95 | 1.90 | 0.09 | 13.2 | 21.5 | 1.6 |
| 340 | 0.08 | 5.51 | 1.24 | 0.06 | 16.2 | 19.7 | 1.2 |
| 341 | 0.08 | 5.88 | 1.47 | 0.10 | 18.8 | 15.2 | 0.8 |
| 342 | 0.09 | 6.29 | 1.08 | 0.10 | 11.6 | 10.9 | 0.9 |
| 343 | 0.10 | 4.07 | 0.99 | 0.09 | 10.1 | 11.1 | 1.1 |
| 344 | 0.06 | 8.93 | 1.57 | 0.04 | 24.9 | 37.9 | 1.5 |
| 345 | 0.18 | 6.65 | 1.78 | 0.16 | 9.7 | 11.5 | 1.2 |
| 346 | 0.04 | 4.24 | 1.28 | 0.02 | 31.8 | 73.1 | 2.3 |
| 347 | 0.96 | 14.12 | 5.38 | 0.64 | 5.6 | 8.4 | 1.5 |
| 348 | 0.05 | 8.15 | 2.05 | 0.03 | 42.2 | 58.8 | 1.4 |
| 349 | 0.26 | 10.60 | 5.14 | 0.06 | 19.6 | 86.3 | 4.4 |
| 350 | 0.40 | 6.46 | 18.59 | 2.62 | 46.3 | 7.1 | 0.2 |
| 1 | 0.08 | 13.09 | 1.93 | 0.08 | 24.9 | 22.8 | 0.9 |

TABLE 23

Electrophysiology by IonWorks ® Quattro patch clamp system: Substitutions at position 27 or 28 relative to SEQ ID NO: 1.

| SEQ ID NO. | Amino Acid Sequence | Designation | IWQ Use Nav1.7 (μM) |
|---|---|---|---|
| 11 | {H}-DCLGFMRKCIPDNDKCCRPNLVCSRTAKWCKYVF-{Amide} | [Ala27]GpTx-1(1-34) | 0.95 |
| 29 | {H}-DCLGFMRKCIPDNDKCCRPNLVCSRTEKWCKYVF-{Amide} | [Glu27]GpTx-1(1-34) | 8.54 |
| 55 | {H}-DCLGFMRKCIPDNDKCCRPNLVCSRTKKWCKYVF-{Amide} | [Lys27]GpTx-1(1-34) | 1.51 |
| 71 | {H}-DCLGFMRKCIPDNDKCCRPNLVCSRTRKWCKYVF-{Amide} | [Arg27]GpTx-1(1-34) | 0.51 |
| 84 | {H}-DCLGFMRKCIPDNDKCCRPNLVCSRTWKWCKYVF-{Amide} | [Trp27]GpTx-1(1-34) | 0.32 |
| 166 | {H}-DCLGFMRKCIPDNDKCCRPNLVCSRT[1-Nal]KWCKYVF-{Amide} | [1-Nal27]GpTx-1(1-34) | 0.30 |
| 109 | {H}-DCLGFMRKCIPDNDKCCRPNLVCSRTFKWCKYVF-{Amide} | [Phe27]GpTx-1(1-34) | 0.22 |
| 110 | {H}-DCLGFMRKCIPDNDKCCRPNLVCSRTYKWCKYVF-{Amide} | [Tyr27]GpTx-1(1-34) | 0.19 |

TABLE 23-continued

| Electrophysiology by IonWorks ® Quattro patch clamp system: Substitutions at position 27 or 28 relative to SEQ ID NO: 1. | | |
|---|---|---|
| 111 {H}-DCLGFMRKCIPDNDKCCRPNLVCSRTLKWCKYVF-{Amide} | [Leu27]GpTx-1(1-34) | 1.15 |
| 351 {H}-DCLGFMRKCIPDNDKCCRPNLVCSRT[4CO2-F]KWCKYVF-{Amide} | [4CO2-F27]GpTx-1(1-34) | 15.44 |
| 352 {H}-DCLGFMRKCIPDNDKCCRPNLVCSRT[2PAL]KWCKYVF-{Amide} | [2PAL27]GpTx-1(1-34) | 0.09 |
| 353 {H}-DCLGFMRKCIPDNDKCCRPNLVCSRT[SDMA]KWCKYVF-{Amide} | [SDMA27]GpTx-1(1-34) | 2.00 |
| 354 {H}-DCLGFMRKCIPDNDKCCRPNLVCSRT[K(Me2)]KWCKYVF-{Amide} | [K(Me2)27]GpTx-1(1-34) | 7.00 |
| 12 {H}-DCLGFMRKCIPDNDKCCRPNLVCSRTHAWCKYVF-{Amide} | [Ala28]GpTx-1(1-34) | 0.36 |
| 153 {H}-DCLGFMRKCIPDNDKCCRPNLVCSRTHEWCKYVF-{Amide} | [Glu28]GpTx-1(1-34) | 0.34 |
| 72 {H}-DCLGFMRKCIPDNDKCCRPNLVCSRTHRWCKYVF-{Amide} | [Arg28]GpTx-1(1-34) | 0.08 |
| 355 {H}-DCLGFMRKCIPDNDKCCRPNLVCSRTH[K(Me2)]WCKYVF-{Amide} | [K(Me2)28]GpTx-1(1-34) | 0.27 |
| 356 {H}-DCLGFMRKCIPDNDKCCRPNLVCSRTH[SDMA]WCKYVF-{Amide} | [SDMA28]GpTx-1(1-34) | 0.18 |
| 1 {H}-DCLGFMRKCIPDNDKCCRPNLVCSRTHKWCKYVF-{Amide} | GpTx-1(1-34) | 0.08 |

| SEQ ID NO. | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|
| 11 | 14.71 | 3.94 | 1.15 | 4.1 | 3.4 | 0.8 |
| 29 | 15.16 | 21.40 | 12.26 | 2.5 | 1.7 | 0.7 |
| 55 | 11.53 | 6.16 | 2.48 | 4.1 | 2.5 | 0.6 |
| 71 | 5.22 | 2.61 | 0.51 | 5.2 | 5.1 | 1.0 |
| 84 | 5.59 | 2.57 | 0.59 | 8.0 | 4.4 | 0.5 |
| 166 | 0.88 | 0.62 | 0.43 | 2.0 | 1.5 | 0.7 |
| 109 | 2.06 | 2.92 | 0.53 | 13.2 | 5.5 | 0.4 |
| 110 | 6.39 | 5.78 | 0.31 | 29.9 | 18.4 | 0.6 |
| 111 | 6.19 | 9.04 | 1.01 | 7.9 | 8.9 | 1.1 |
| 351 | 6.65 | 19.35 | 8.41 | 1.3 | 2.3 | 1.8 |
| 352 | 7.82 | 2.93 | 0.05 | 33.5 | 61.4 | 1.8 |
| 353 | 8.32 | 9.84 | 2.42 | 4.9 | 4.1 | 0.8 |
| 354 | 12.39 | 11.94 | 3.82 | 1.7 | 3.1 | 1.8 |
| 12 | 17.34 | 6.86 | 0.66 | 19.2 | 10.4 | 0.5 |

TABLE 23-continued

Electrophysiology by IonWorks ® Quattro patch clamp system:
Substitutions at position 27 or 28 relative to SEQ ID NO: 1.

| | | | | | | |
|---|---|---|---|---|---|---|
| 153 | 14.07 | 13.93 | 0.80 | 41.4 | 17.5 | 0.4 |
| 72 | 8.95 | 7.55 | 0.13 | 93.8 | 58.1 | 0.6 |
| 355 | 8.73 | 14.42 | 0.19 | 54.4 | 76.5 | 1.4 |
| 356 | 9.52 | 5.01 | 0.23 | 28.1 | 22.1 | 0.8 |
| 1 | 13.09 | 1.93 | 0.08 | 24.9 | 22.8 | 0.9 |

TABLE 24

Electrophysiology by IonWorks ® Quattro patch clamp system: Substitutions at position 29 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 47 | {H}-DCLGFMRKCIPDNDKCCRPNLVCSRTHKACKYVF-{Amide} | [Ala29]GpTx-1(1-34) | 11.74 | 16.17 | 4.49 | 27.50 | 0.4 | 0.2 | 0.4 |
| 30 | {H}-DCLGFMRKCIPDNDKCCRPNLVCSRTHKECKYVF-{Amide} | [Glu29]GpTx-1(1-34) | 18.06 | 18.91 | 23.53 | 16.05 | 1.3 | 1.5 | 1.1 |
| 56 | {H}-DCLGFMRKCIPDNDKCCRPNLVCSRTHKKCKYVF-{Amide} | [Lys29]GpTx-1(1-34) | 20.10 | 14.74 | 27.34 | 24.53 | 1.4 | 1.1 | 0.8 |
| 104 | {H}-DCLGFMRKCIPDNDKCCRPNLVCSRTHKRCKYVF-{Amide} | [Arg29]GpTx-1(1-34) | 9.73 | 18.76 | 7.35 | 11.39 | 0.8 | 0.6 | 0.9 |
| 79 | {H}-DCLGFMRKCIPDNDKCCRPNLVCSRTHK[1-Nal]CKYVF-{Amide} | [1-Nal29]GpTx-1(1-34) | 0.46 | 9.25 | 16.23 | 1.55 | 35.1 | 10.5 | 0.3 |
| 113 | {H}-DCLGFMRKCIPDNDKCCRPNLVCSRTHKYCKYVF-{Amide} | [Tyr29]GpTx-1(1-34) | 1.46 | 9.49 | 9.52 | 4.03 | 6.5 | 2.4 | 0.4 |
| 114 | {H}-DCLGFMRKCIPDNDKCCRPNLVCSRTHKLCKYVF-{Amide} | [Leu29]GpTx-1(1-34) | 6.99 | 7.27 | 23.17 | 9.80 | 3.3 | 2.4 | 0.7 |
| 112 | {H}-DCLGFMRKCIPDNDKCCRPNLVCSRTHKFCKYVF-{Amide} | [Phe29]GpTx-1(1-34) | 2.18 | 6.21 | 15.19 | 4.82 | 7.0 | 3.1 | 0.5 |
| 129 | {H}-DCLGFMRKCIPDNDKCCRPNLVCSRTHK[2-Nal]CKYVF-{Amide} | [2-Nal29]GpTx-1(1-34) | 0.58 | 11.67 | 9.46 | 0.73 | 16.2 | 12.9 | 0.8 |
| 357 | {H}-DCLGFMRKCIPDNDKCCRPNLVCSRTHK[NMeTrp]CKYVF-{Amide} | [NMeTrp29]GpTx-1(1-34) | >5 | >5 | >5 | >5 | — | — | — |
| 358 | {H}-DCLGFMRKCIPDNDKCCRPNLVCSRTHK[pl-Phe]CKYVF-{Amide} | [pI-Phe29]GpTx-1(1-34) | 1.01 | 14.90 | 12.98 | 1.27 | 12.9 | 10.2 | 0.8 |

TABLE 24-continued

Electrophysiology by IonWorks ® Quattro patch clamp system: Substitutions at position 29 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 359 | {H}-DCLGFMRKCIPDNDKCCRPNLVCSRTHK[NMePhe]CKYVF-{Amide} | [NMePhe29]GpTx-1(1-34) | 19.15 | 18.84 | 15.35 | 7.39 | 0.8 | 2.1 | 2.6 |
| 360 | {H}-DCLGFMRKCIPDNDKCCRPNLVCSRTHK[Bip]CKYVF-{Amide} | [Bip29]GpTx-1(1-34) | 4.79 | 9.77 | 19.69 | 6.95 | 4.1 | 2.8 | 0.7 |
| 361 | {H}-DCLGFMRKCIPDNDKCCRPNLVCSRTHK[1'NMeW]CKYVF-{Amide} | [1'NMeW29]GpTx-1(1-34) | 3.89 | 12.24 | 7.04 | 4.58 | 1.8 | 1.5 | 0.9 |
| 362 | {H}-DCLGFMRKCIPDNDKCCRPNLVCSRTHK[Phg]CKYVF-{Amide} | [Phg29]GpTx-1(1-34) | 5.52 | 7.85 | 16.33 | 3.18 | 3.0 | 5.1 | 1.7 |
| 363 | {H}-DCLGFMRKCIPDNDKCCRPNLVCSRTHK[4CO2-F]CKYVF-{Amide} | [4CO2-F29]GpTx-1(1-34) | 15.03 | 18.77 | 19.34 | 14.94 | 1.3 | 1.3 | 1.0 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |

TABLE 25

Electrophysiology by IonWorks ® Quattro patch clamp system: Substitutions at position 31 or 32 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 13 | {H}-DCLGFMRKCIPDNDKCCRPNLVCSRTHKWCAYVF-{Amide} | [Ala31]GpTx-1(1-34) | 7.94 | 14.54 | 5.96 | 7.39 | 0.7 | 0.8 | 1.1 |
| 31 | {H}-DCLGFMRKCIPDNDKCCRPNLVCSRTHKWCEYVF-{Amide} | [Glu31]GpTx-1(1-34) | 22.96 | 21.69 | 20.41 | 13.06 | 0.9 | 1.6 | 1.8 |
| 73 | {H}-DCLGFMRKCIPDNDKCCRPNLVCSRTHKWCRYVF-{Amide} | [Arg31]GpTx-1(1-34) | 1.36 | 9.17 | 7.14 | 4.95 | 5.2 | 1.4 | 0.3 |
| 179 | {H}-DCLGFMRKCIPDNDKCCRPNLVCSRTHKWCWYVF-{Amide} | [Trp31]GpTx-1(1-34) | 23.61 | 10.84 | 21.31 | 10.17 | 0.9 | 2.1 | 2.3 |
| 364 | {H}-DCLGFMRKCIPDNDKCCRPNLVCSRTHKWC[2PAL]YVF-{Amide} | [2PAL31]GpTx-1(1-34) | 10.95 | 9.49 | 21.73 | 16.93 | 2.0 | 1.3 | 0.6 |
| 365 | {H}-DCLGFMRKCIPDNDKCCRPNLVCSRTHKWC[SDMA]YVF-{Amide} | [SDMA31]GpTx-1(1-34) | 4.15 | 14.21 | 10.75 | 4.55 | 2.6 | 2.4 | 0.9 |
| 14 | {H}-DCLGFMRKCIPDNDKCCRPNLVCSRTHKWCKAVF-{Amide} | [Ala32]GpTx-1(1-34) | 0.80 | 20.61 | 5.96 | 0.77 | 7.5 | 7.8 | 1.0 |
| 32 | {H}-DCLGFMRKCIPDNDKCCRPNLVCSRTHKWCKEVF-{Amide} | [Glu32]GpTx-1(1-34) | 13.95 | 22.80 | 22.80 | 9.14 | 1.6 | 2.5 | 1.5 |
| 57 | {H}-DCLGFMRKCIPDNDKCCRPNLVCSRTHKWCKKVF-{Amide} | [Lys32]GpTx-1(1-34) | 4.96 | 10.89 | 15.71 | 4.19 | 3.2 | 3.8 | 1.2 |
| 159 | {H}-DCLGFMRKCIPDNDKCCRPNLVCSRTHKWCKRVF-{Amide} | [Arg32]GpTx-1(1-34) | 1.02 | 8.65 | 18.71 | 0.87 | 18.4 | 21.5 | 1.2 |
| 85 | {H}-DCLGFMRKCIPDNDKCCRPNLVCSRTHKWCKWVF-{Amide} | [Trp32]GpTx-1(1-34) | 0.09 | 6.74 | 4.99 | 0.16 | 53.5 | 31.3 | 0.6 |
| 167 | {H}-DCLGFMRKCIPDNDKCCRPNLVCSRTHKWCK[1-Nal]VF-{Amide} | [1-Nal32]GpTx-1(1-34) | 0.004 | 3.96 | 0.15 | 0.001 | 36.0 | 135.0 | 3.8 |
| 246 | {H}-DCLGFMRKCIPDNDKCCRPNLVCSRTHKWCK[1'NMeW]VF-{Amide} | [1'NMeW32]GpTx-1(1-34) | 0.06 | 14.44 | 21.36 | 0.03 | 372.6 | 806.3 | 2.2 |
| 366 | {H}-DCLGFMRKCIPDNDKCCRPNLVCSRTHKWCKQVF-{Amide} | [Gln32]GpTx-1(1-34) | 4.87 | 21.01 | 12.08 | 2.39 | 2.5 | 5.1 | 2.0 |

TABLE 25-continued

Electrophysiology by IonWorks ® Quattro patch clamp system: Substitutions at position 31 or 32 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 367 | {H}-DCLGFMRKCIPDNDKCCRPNLVCSRTHKWCKIVF-{Amide} | [Ile32]GpTx-1(1-34) | 0.07 | 8.71 | 1.33 | 0.06 | 19.9 | 23.0 | 1.2 |
| 368 | {H}-DCLGFMRKCIPDNDKCCRPNLVCSRTHKWCKMVF-{Amide} | [Met32]GpTx-1(1-34) | 0.35 | 6.21 | 5.99 | 0.14 | 17.1 | 42.9 | 2.5 |
| 369 | {H}-DCLGFMRKCIPDNDKCCRPNLVCSRTHKWCKTVF-{Amide} | [Thr32]GpTx-1(1-34) | 3.54 | 11.05 | 11.19 | 3.29 | 3.2 | 3.4 | 1.1 |
| 370 | {H}-DCLGFMRKCIPDNDKCCRPNLVCSRTHKWCK[NMePhe]VF-{Amide} | [NMePhe32]GpTx-1(1-34) | >5 | >5 | >5 | >5 | — | — | — |
| 371 | {H}-DCLGFMRKCIPDNDKCCRPNLVCSRTHKWCK[NMeTrp]VF-{Amide} | [NMeTrp32]GpTx-1(1-34) | 4.88 | >5 | >5 | >5 | — | — | — |
| 372 | {H}-DCLGFMRKCIPDNDKCCRPNLVCSRTHKWCKVVF-{Amide} | [Val32]GpTx-1(1-34) | 0.15 | 14.81 | 1.59 | 0.08 | 10.7 | 19.5 | 1.8 |
| 373 | {H}-DCLGFMRKCIPDNDKCCRPNLVCSRTHKWCKLVF-{Amide} | [Leu32]GpTx-1(1-34) | 0.12 | 8.83 | 1.19 | 0.08 | 10.0 | 14.1 | 1.4 |
| 374 | {H}-DCLGFMRKCIPDNDKCCRPNLVCSRTHKWCK[Phg]VF-{Amide} | [Phg32]GpTx-1(1-34) | 0.14 | 7.06 | 1.80 | 0.10 | 13.2 | 18.9 | 1.4 |
| 375 | {H}-DCLGFMRKCIPDNDKCCRPNLVCSRTHKWCK[Cha]VF-{Amide} | [Cha32]GpTx-1(1-34) | 0.05 | 8.88 | 0.39 | 0.02 | 8.0 | 16.7 | 2.1 |
| 376 | {H}-DCLGFMRKCIPDNDKCCRPNLVCSRTHKWCK[Bip]VF-{Amide} | [Bip32]GpTx-1(1-34) | 0.03 | 2.90 | 0.19 | 0.00 | 7.0 | 68.6 | 9.8 |
| 377 | {H}-DCLGFMRKCIPDNDKCCRPNLVCSRTHKWCKFVF-{Amide} | [Phe32]GpTx-1(1-34) | 0.05 | 6.84 | 0.67 | 0.05 | 12.3 | 13.7 | 1.1 |
| 378 | {H}-DCLGFMRKCIPDNDKCCRPNLVCSRTHKWCKGVF-{Amide} | [Gly32]GpTx-1(1-34) | 0.71 | 11.18 | 7.97 | 0.62 | 11.3 | 12.8 | 1.1 |
| 379 | {H}-DCLGFMRKCIPDNDKCCRPNLVCSRTHKWCKNVF-{Amide} | [Asn32]GpTx-1(1-34) | 4.86 | 10.56 | 8.40 | 6.85 | 1.7 | 1.2 | 0.7 |

TABLE 25-continued

Electrophysiology by IonWorks ® Quattro patch clamp system: Substitutions at position 31 or 32 relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 380 | {H}-DCLGFMRKCIPDNDKCCRPNLVCSRTHKWCKHVF-{Amide} | [His32]GpTx-1(1-34) | 0.60 | 10.16 | 7.18 | 0.75 | 11.9 | 9.6 | 0.8 |
| 381 | {H}-DCLGFMRKCIPDNDKCCRPNLVCSRTHKWCK[pI-Phe]VF-{Amide} | [pI-Phe32]GpTx-1(1-34) | 0.03 | 4.44 | 0.30 | 0.01 | 11.7 | 49.6 | 4.3 |
| 382 | {H}-DCLGFMRKCIPDNDKCCRPNLVCSRTHKWCKSVF-{Amide} | [Ser32]GpTx-1(1-34) | 3.95 | >5 | >5 | 1.47 | — | — | 2.7 |
| 383 | {H}-DCLGFMRKCIPDNDKCCRPNLVCSRTHKWCKPVF-{Amide} | [Pro32]GpTx-1(1-34) | >5 | >5 | >5 | >5 | — | — | — |
| 384 | {H}-DCLGFMRKCIPDNDKCCRPNLVCSRTHKWCK[2PAL]VF-{Amide} | [2PAL32]GpTx-1(1-34) | 0.81 | 7.65 | 19.08 | 0.66 | 23.4 | 28.8 | 1.2 |
| 385 | {H}-DCLGFMRKCIPDNDKCCRPNLVCSRTHKWCK[4CO2-F]VF-{Amide} | [4CO2-F32]GpTx-1(1-34) | 11.42 | 7.70 | 19.26 | 4.05 | 1.7 | 4.8 | 2.8 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |

TABLE 26

| Electrophysiology by IonWorks ® Quattro patch clamp system: Substitutions at position 33 relative to SEQ ID NO: 1. | | |
|---|---|---|
| SEQ ID NO. | Amino Acid Sequence | Designation |
| 15 | {H}-DCLGFMRKCIPDNDKCCRPNLVCSRTHKWCKYAF-{Amide} | [Ala33]GpTx-1(1-34) |
| 33 | {H}-DCLGFMRKCIPDNDKCCRPNLVCSRTHKWCKYEF-{Amide} | [Glu33]GpTx-1(1-34) |
| 58 | {H}-DCLGFMRKCIPDNDKCCRPNLVCSRTHKWCKYKF-{Amide} | [Lys33]GpTx-1(1-34) |
| 74 | {H}-DCLGFMRKCIPDNDKCCRPNLVCSRTHKWCKYRF-{Amide} | [Arg33]GpTx-1(1-34) |
| 180 | {H}-DCLGFMRKCIPDNDKCCRPNLVCSRTHKWCKYWF-{Amide} | [Trp33]GpTx-1(1-34) |
| 168 | {H}-DCLGFMRKCIPDNDKCCRPNLVCSRTHKWCKY[1-Nal]F-{Amide} | [1-Nal33]GpTx-1(1-34) |
| 95 | {H}-DCLGFMRKCIPDNDKCCRPNLVCSRTHKWCKYQF-{Amide} | [Gln33]GpTx-1(1-34) |
| 248 | {H}-DCLGFMRKCIPDNDKCCRPNLVCSRTHKWCKYIF-{Amide} | [Ile33]GpTx-1(1-34) |
| 249 | {H}-DCLGFMRKCIPDNDKCCRPNLVCSRTHKWCKY[pI-Phe]F-{Amide} | [pI-Phe33]GpTx-1(1-34) |
| 250 | {H}-DCLGFMRKCIPDNDKCCRPNLVCSRTHKWCKY[1'NMeW]F-{Amide} | [1'NMeW33]GpTx-1(1-34) |
| 386 | {H}-DCLGFMRKCIPDNDKCCRPNLVCSRTHKWCKY[Cha]F-{Amide} | [Cha33]GpTx-1(1-34) |
| 388 | {H}-DCLGFMRKCIPDNDKCCRPNLVCSRTHKWCKY[NMePhe]F-{Amide} | [NMePhe33]GpTx-1(1-34) |
| 389 | {H}-DCLGFMRKCIPDNDKCCRPNLVCSRTHKWCKY[NMeTrp]F-{Amide} | [NMeTrp33]GpTx-1(1-34) |
| 390 | {H}-DCLGFMRKCIPDNDKCCRPNLVCSRTHKWCKYFF-{Amide} | [Phe33]GpTx-1(1-34) |
| 391 | {H}-DCLGFMRKCIPDNDKCCRPNLVCSRTHKWCKYMF-{Amide} | [Met33]GpTx-1(1-34) |
| 392 | {H}-DCLGFMRKCIPDNDKCCRPNLVCSRTHKWCKYHF-{Amide} | [His33]GpTx-1(1-34) |
| 393 | {H}-DCLGFMRKCIPDNDKCCRPNLVCSRTHKWCKY[Phg]F-{Amide} | [Phg33]GpTx-1(1-34) |
| 394 | {H}-DCLGFMRKCIPDNDKCCRPNLVCSRTHKWCKYNF-{Amide} | [Asn33]GpTx-1(1-34) |
| 395 | {H}-DCLGFMRKCIPDNDKCCRPNLVCSRTHKWCKYDF-{Amide} | [Asp33]GpTx-1(1-34) |
| 396 | {H}-DCLGFMRKCIPDNDKCCRPNLVCSRTHKWCKYTF-{Amide} | [Thr33]GpTx-1(1-34) |
| 397 | {H}-DCLGFMRKCIPDNDKCCRPNLVCSRTHKWCKYSF-{Amide} | [Ser33]GpTx-1(1-34) |
| 398 | {H}-DCLGFMRKCIPDNDKCCRPNLVCSRTHKWCKYPF-{Amide} | [Pro33]GpTx-1(1-34) |

TABLE 26-continued

| Electrophysiology by IonWorks ® Quattro patch clamp system: Substitutions at position 33 relative to SEQ ID NO: 1. | |
|---|---|
| 399 {H}-DCLGFMRKCIPDNDKCCRPNLVCSRTHKWCKYYF-{Amide} | [Tyr33]GpTx-1(1-34) |
| 400 {H}-DCLGFMRKCIPDNDKCCRPNLVCSRTHKWCKYLF-{Amide} | [Leu33]GpTx-1(1-34) |
| 401 {H}-DCLGFMRKCIPDNDKCCRPNLVCSRTHKWCKYGF-{Amide} | [Gly33]GpTx-1(1-34) |
| 402 {H}-DCLGFMRKCIPDNDKCCRPNLVCSRTHKWCKY[2PAL]F-{Amide} | [2PAL33]GpTx-1(1-34) |
| 403 {H}-DCLGFMRKCIPDNDKCCRPNLVCSRTHKWCKY[4CO2-F]F-{Amide} | [4CO2-F33]GpTx-1(1-34) |
| 1 {H}-DCLGFMRKCIPDNDKCCRPNLVCSRTHKWCKYVF-{Amide} | GpTx-1(1-34) |

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|
| 15 | 0.33 | 18.60 | 4.40 | 0.35 | 13.5 | 12.5 | 0.9 |
| 33 | 0.56 | 11.48 | 10.26 | 0.39 | 18.4 | 26.3 | 1.4 |
| 58 | 0.07 | 9.56 | 1.28 | 0.07 | 18.6 | 19.3 | 1.0 |
| 74 | 0.08 | 9.55 | 2.11 | 0.05 | 26.7 | 40.0 | 1.5 |
| 180 | 0.05 | 9.06 | 0.63 | 0.009 | 12.0 | 70.3 | 5.9 |
| 168 | 0.06 | 15.74 | 0.57 | 0.02 | 9.2 | 26.7 | 2.9 |
| 95 | 0.12 | 10.59 | 9.56 | 0.11 | 81.2 | 85.7 | 1.1 |
| 248 | 0.15 | 6.89 | 21.63 | 0.09 | 142.1 | 238.9 | 1.7 |
| 249 | 0.09 | 7.78 | 11.54 | 0.06 | 127.3 | 192.9 | 1.5 |
| 250 | 0.09 | 5.35 | 7.87 | 0.07 | 88.9 | 120.1 | 1.4 |
| 386 | 0.07 | 12.18 | 1.12 | 0.07 | 15.4 | 15.5 | 1.0 |
| 388 | 1.28 | >5 | 4.91 | 1.09 | 3.8 | 4.5 | 1.2 |
| 389 | 0.35 | >5 | 1.55 | 0.29 | 4.5 | 5.4 | 1.2 |
| 390 | 0.06 | 8.66 | 0.74 | 0.04 | 12.7 | 18.5 | 1.5 |
| 391 | 0.07 | 15.06 | 1.54 | 0.08 | 20.8 | 20.3 | 1.0 |
| 392 | 0.02 | 8.16 | 0.32 | 0.01 | 19.6 | 33.2 | 1.7 |
| 393 | 0.02 | 7.63 | 0.50 | 0.04 | 22.9 | 13.1 | 0.6 |
| 394 | 0.36 | 7.94 | 1.22 | 0.07 | 3.4 | 16.3 | 4.8 |
| 395 | 0.77 | 8.79 | 3.87 | 0.17 | 5.0 | 22.4 | 4.4 |
| 396 | 0.02 | 3.78 | 1.29 | 0.04 | 70.8 | 28.9 | 0.4 |
| 397 | 0.04 | 6.28 | 1.14 | 0.06 | 26.0 | 19.0 | 0.7 |
| 398 | 5.19 | 6.93 | 6.87 | 3.34 | 1.3 | 2.1 | 1.6 |
| 399 | 0.07 | >5 | 2.03 | 0.03 | 30.3 | 69.4 | 2.3 |
| 400 | 0.13 | >5 | 0.82 | 0.07 | 6.3 | 11.3 | 1.8 |
| 401 | 0.29 | >5 | 1.62 | 0.04 | 5.6 | 40.0 | 7.1 |
| 402 | 0.12 | 8.36 | 11.61 | 0.16 | 98.2 | 72.3 | 0.7 |

TABLE 26-continued

| Electrophysiology by IonWorks ® Quattro patch clamp system: Substitutions at position 33 relative to SEQ ID NO: 1. | | | | | | | |
|---|---|---|---|---|---|---|---|
| 403 | 0.16 | 9.06 | 9.23 | 0.31 | 59.1 | 29.8 | 0.5 |
| 1 | 0.08 | 13.09 | 1.93 | 0.08 | 24.9 | 22.8 | 0.9 |

TABLE 27

Electrophysiology by IonWorks ® Quattro patch clamp system: Substitutions at position 34 relative to SEQ ID NO: 1.

| SEQ ID NO. | Amino Acid Sequence | Designation |
|---|---|---|
| 101 | {H}-DCLGFMRKCIPDNDKCCRPNLVCSRTHKWCKYVA-{Amide} | [Ala34]GpTx-1(1-34) |
| 34 | {H}-DCLGFMRKCIPDNDKCCRPNLVCSRTHKWCKYVE-{Amide} | [Glu34]GpTx-1(1-34) |
| 59 | {H}-DCLGFMRKCIPDNDKCCRPNLVCSRTHKWCKYVK-{Amide} | [Lys34]GpTx-1(1-34) |
| 75 | {H}-DCLGFMRKCIPDNDKCCRPNLVCSRTHKWCKYVR-{Amide} | [Arg34]GpTx-1(1-34) |
| 86 | {H}-DCLGFMRKCIPDNDKCCRPNLVCSRTHKWCKYVW-{Amide} | [Trp34]GpTx-1(1-34) |
| 80 | {H}-DCLGFMRKCIPDNDKCCRPNLVCSRTHKWCKYV[1-Nal]-{Amide} | [1-Nal34]GpTx-1(1-34) |
| 96 | {H}-DCLGFMRKCIPDNDKCCRPNLVCSRTHKWCKYVI-{Amide} | [Ile34]GpTx-1(1-34) |
| 122 | {H}-DCLGFMRKCIPDNDKCCRPNLVCSRTHKWCKYVL-{Amide} | [Leu34]GpTx-1(1-34) |
| 130 | {H}-DCLGFMRKCIPDNDKCCRPNLVCSRTHKWCKYV[2-Nal]-{Amide} | [2-Nal34]GpTx-1(1-34) |
| 404 | {H}-DCLGFMRKCIPDNDKCCRPNLVCSRTHKWCKYVf-{Amide} | [D-Phe34]GpTx-1(1-34) |
| 405 | {H}-DCLGFMRKCIPDNDKCCRPNLVCSRTHKWCKYV[Cha]-{Amide} | [Cha34]GpTx-1(1-34) |
| 406 | {H}-DCLGFMRKCIPDNDKCCRPNLVCSRTHKWCKYV[Phg]-{Amide} | [Phg34]GpTx-1(1-34) |
| 407 | {H}-DCLGFMRKCIPDNDKCCRPNLVCSRTHKWCKYV[NMeTrp]-{Amide} | [NMeTrp34]GpTx-1(1-34) |
| 408 | {H}-DCLGFMRKCIPDNDKCCRPNLVCSRTHKWCKYV[NMePhe]-{Amide} | [NMePhe34]GpTx-1(1-34) |
| 409 | {H}-DCLGFMRKCIPDNDKCCRPNLVCSRTHKWCKYV[1'NMeW]-{Amide} | [1'NMeW34]GpTx-1(1-34) |
| 410 | {H}-DCLGFMRKCIPDNDKCCRPNLVCSRTHKWCKYV[4CO2-F]-{Amide} | [4CO2-F34]GpTx-1(1-34) |
| 411 | {H}-DCLGFMRKCIPDNDKCCRPNLVCSRTHKWCKYV[2PAL]-{Amide} | [2PAL34]GpTx-1(1-34) |
| 1 | {H}-DCLGFMRKCIPDNDKCCRPNLVCSRTHKWCKYVF-{Amide} | GpTx-1(1-34) |

TABLE 27-continued

Electrophysiology by IonWorks ® Quattro patch clamp system: Substitutions at position 34 relative to SEQ ID NO: 1.

| SEQ ID NO. | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|
| 101 | 7.19 | 9.33 | 16.41 | 4.76 | 2.3 | 3.5 | 1.5 |
| 34 | 16.98 | 16.76 | 16.97 | 11.17 | 1.0 | 1.5 | 1.5 |
| 59 | 5.68 | 18.06 | 20.19 | 7.74 | 3.6 | 2.6 | 0.7 |
| 75 | 3.58 | 8.99 | 22.67 | 4.69 | 6.3 | 4.8 | 0.8 |
| 86 | 0.26 | 10.02 | 6.70 | 0.18 | 25.7 | 36.3 | 1.4 |
| 80 | 0.02 | 10.24 | 0.94 | 0.03 | 40.9 | 31.5 | 0.8 |
| 96 | 0.28 | 10.79 | 5.33 | 0.28 | 18.8 | 19.0 | 1.0 |
| 122 | 0.24 | 8.46 | 3.31 | 0.13 | 13.5 | 25.4 | 1.9 |
| 130 | 0.04 | 3.59 | 0.34 | 0.02 | 8.7 | 14.3 | 1.6 |
| 404 | 0.98 | 20.72 | 6.15 | 0.52 | 6.3 | 11.8 | 1.9 |
| 405 | 0.02 | 5.53 | 0.63 | 0.01 | 26.3 | 57.7 | 2.2 |
| 406 | 0.04 | 5.95 | 0.27 | 0.02 | 6.2 | 11.9 | 1.9 |
| 407 | 6.85 | 10.16 | 10.29 | 4.64 | 1.5 | 2.2 | 1.5 |
| 408 | 10.05 | 18.85 | 9.29 | 4.56 | 0.9 | 2.0 | 2.2 |
| 409 | 0.09 | 5.61 | 1.22 | 0.07 | 14.1 | 18.3 | 1.3 |
| 410 | 9.19 | 7.11 | 21.92 | 6.31 | 2.4 | 3.5 | 1.5 |
| 411 | 5.82 | 8.16 | 21.31 | 4.83 | 3.7 | 4.4 | 1.2 |
| 1 | 0.08 | 13.09 | 1.93 | 0.08 | 24.9 | 22.8 | 0.9 |

TABLE 28

Electrophysiology by IonWorks ® Quattro patch clamp system: Substitutions at position 35 and C-terminal deletions relative to SEQ ID NO: 1 and free acids

| SEQ ID NO. | Amino Acid Sequence | Designation | IWQ Use Nav1.7 (μm) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 16 | {H}-DCLGFMRKCIPDNDKCCRPNLVCSRTHKWCKYVFA-{Amide} | GpTx-1(1-34)-Ala | 0.41 | 14.15 | 7.13 | 0.26 | 17.6 | 27.2 | 1.5 |
| 35 | {H}-DCLGFMRKCIPDNDKCCRPNLVCSRTHKWCKYVFE-{Amide} | GpTx-1(1-34)-Glu | 4.47 | 19.59 | 21.73 | 2.47 | 4.9 | 8.8 | 1.8 |
| 60 | {H}-DCLGFMRKCIPDNDKCCRPNLVCSRTHKWCKYVFK-{Amide} | GpTx-1(1-34)-Lys | 0.59 | 12.53 | 7.00 | 0.21 | 11.8 | 32.7 | 2.8 |
| 76 | {H}-DCLGFMRKCIPDNDKCCRPNLVCSRTHKWCKYVFR-{Amide} | GpTx-1(1-34)-Arg | 0.30 | 9.73 | 5.53 | 0.10 | 18.5 | 56.3 | 3.0 |
| 131 | {H}-DCLGFMRKCIPDNDKCCRPNLVCSRTHKWCKYVF[2-Nal]-{Amide} | GpTx-1(1-34)-2-Nal | 0.05 | 2.55 | 0.44 | 0.02 | 9.2 | 18.2 | 2.0 |
| 87 | {H}-DCLGFMRKCIPDNDKCCRPNLVCSRTHKWCKYVFW-{Amide} | GpTx-1(1-34)-Trp | 0.05 | 7.87 | 2.69 | 0.07 | 55.0 | 36.0 | 0.7 |

TABLE 28-continued

Electrophysiology by IonWorks ® Quattro patch clamp system: Substitutions at position 35 and C-terminal deletions relative to SEQ ID NO: 1 and free acids

| SEQ ID NO. | Amino Acid Sequence | Designation | IWQ Use Nav1.7 (μm) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 133 | {H}-DCLGFMRKCIPDNDKCCRPNLVCSRTHKWCKYVFW-{FreeAcid} | GpTx-1(1-34)-Trp-FreeAcid | 0.48 | 8.28 | 2.15 | 0.11 | 4.5 | 19.9 | 4.4 |
| 412 | {H}-DCLGFMRKCIPDNDKCCRPNLVCSRTHKWCKYVF[2-Nal]-{Amide} | GpTx-1(1-34)-2-Nal | 0.05 | 2.55 | 0.44 | 0.02 | 9.2 | 18.2 | 2.0 |
| 413 | {H}-DCLGFMRKCIPDNDKCCRPNLVCSRTHKWCKYVF[4CO2-F]-{Amide} | GpTx-1(1-34)-4CO2-F | 1.15 | 8.65 | 12.34 | 5.35 | 10.7 | 2.3 | 0.2 |
| 414 | {H}-DCLGFMRKCIPDNDKCCRPNLVCSRTHKWCKYVF[2PAL]-{Amide} | GpTx-1(1-34)-2PAL | 0.26 | 9.29 | 9.78 | 0.63 | 38.1 | 15.5 | 0.4 |
| 415 | {H}-DCLGFMRKCIPDNDKCCRPNLVCSRTHKWCKYV-{Amide} | GpTx-1(1-33) | 2.35 | 10.84 | 10.61 | 1.30 | 4.5 | 8.1 | 1.8 |
| 416 | {H}-DCLGFMRKCIPDNDKCCRPNLVCSRTHKWCKY-{Amide} | GpTx-1(1-32) | 1.50 | 8.64 | 11.48 | 0.88 | 7.6 | 13.1 | 1.7 |
| 417 | {H}-DCLGFMRKCIPDNDKCCRPNLVCSRTHKWCK-{Amide} | GpTx-1(1-31) | 18.32 | 11.88 | 6.94 | 9.09 | 0.4 | 0.8 | 2.0 |
| 107 | {H}-DCLGFMRKCIPDNDKCCRPNLVCSRTHKWCKYVF-{FreeAcid} | GpTx-1(1-34)-FreeAcid | 1.98 | 9.44 | 6.75 | 0.54 | 3.4 | 12.5 | 3.7 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |

TABLE 29

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 2 | {H}-dclgfmrkcipdndkccrpnlvcsrthkwckyvf-{Amide} | [All D-isomer]GpTx-1(1-34) | 7.51 | 11.27 | 18.01 | 21.05 | 2.4 | 0.9 | 0.4 |
| 140 | {H}-DALGFMRKCIPDNDKCARPNLVCSRTHKWCKYVF-{Amide} | [Ala2,17]GpTx-1(1-34) | 2.45 | 18.95 | 15.39 | 0.79 | 6.3 | 19.4 | 3.1 |
| 125 | {H}-D[2-Abu]LGFMRKCIPDNDKC[2-Abu]RPNLVCSRTHKWCKYVF-{Amide} | [2-Abu2,17]GpTx-1(1-34) | 0.30 | 9.51 | 11.58 | 0.24 | 38.9 | 48.6 | 1.2 |
| 135 | {H}-DCLGFMRK[2-Abu]IPDNDKCCRPNLV[2-Abu]SRTHKWCKYVF-{Amide} | [2-Abu9,23]GpTx-1(1-34) | 8.14 | 9.21 | 20.81 | 12.27 | 2.6 | 1.7 | 0.7 |
| 139 | {H}-DCLGFMRKCIPDNDKCCRPNLVCSRTHKWCKYV[2-Nal]W-{Amide} | [2-Nal34]GpTx-1(1-34)-Trp | 0.11 | 2.12 | 0.30 | 0.05 | 2.7 | 6.5 | 2.4 |
| 99 | {H}-DCLGFMRKCIPDNDKCCRPNLVCSRTHKWCKKV[1-Nal]W-{Amide} | [Lys32;1-Nal34]GpTx-1(1-34)-Trp | 0.11 | 9.14 | 3.19 | 0.16 | 28.0 | 20.3 | 0.7 |
| 136 | {H}-DCLG[2-Nal]MRKCIPDNDKCCRPNLVCSRTHKWCKYV[2-Nal]-{Amide} | [2-Nal5,34]GpTx-1(1-34) | 0.14 | 5.14 | 0.29 | 0.03 | 2.1 | 10.7 | 5.1 |
| 137 | {H}-DCLG[2-Nal]MRKCIPDNDKCCRPNLVCSRTHKWCKYV[1-Nal]-{Amide} | [2-Nal5;1-Nal34]GpTx-1(1-34) | 0.11 | 3.15 | 0.24 | 0.02 | 2.2 | 10.4 | 4.7 |
| 134 | {H}-DCLGFMRKCIPDNDKCCEGLVCSRTHKWCKYVF-{Amide} | [Glu18;desAsn20]GpTx-1(1-34) | 0.89 | 11.54 | 8.95 | 0.51 | 10.0 | 17.7 | 1.8 |
| 138 | {H}-DCLGFMRKCIPDNDKCCRPNLVCSRTHKWCKYV[1-Nal]W-{Amide} | [1-Nal34]GpTx-1(1-34)-Trp | 0.13 | 2.57 | 0.55 | 0.07 | 4.3 | 7.8 | 1.8 |
| 127 | {H}-DCLGFMRKCIPDNDKCCRPNLVCSRTHKWCKKVFW-{Amide} | [Lys32]GpTx-1(1-34)-Trp | 0.73 | 18.91 | 8.41 | 0.70 | 11.5 | 12.0 | 1.0 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 252 | {H}-DCLGAMRKCIPDNDKCCRPNLVCSRTHKWCKYWF-{Amide} | [Ala5;Trp33]GpTx-1(1-34) | 0.23 | 5.00 | 3.86 | 0.40 | 16.7 | 9.7 | 0.6 |
| 253 | {H}-DCLGAMRKCIPDNDKCCRPNLVCSRTHKWCKWVF-{Amide} | [Ala5;Trp32]GpTx-1(1-34) | 0.27 | 5.00 | 5.00 | 0.53 | 18.6 | 9.5 | 0.5 |
| 254 | {H}-DCLGAMRKCIPDNDKCCRPNLVCSRTHKWCK[1-Nal]VF-{Amide} | [Ala5;1-Nal32]GpTx-1(1-34) | 0.06 | 5.00 | 4.43 | 0.20 | 77.9 | 21.6 | 0.3 |
| 255 | {H}-DCLGAMRKCIPDNDKCCRPNLVCSRLHKWCKYVF-{Amide} | [Ala5;Leu26]GpTx-1(1-34) | 0.28 | 5.00 | 5.00 | 0.68 | 17.7 | 7.4 | 0.4 |
| 256 | {H}-DCLGA[1-Nal]RKCIPDNDKCCRPNLVCSRTHKWCKYVF-{Amide} | [Ala5;1-Nal6]GpTx-1(1-34) | 0.10 | 5.00 | 1.15 | 0.06 | 11.4 | 19.5 | 1.7 |
| 257 | {H}-DCLGAFRKCIPDNDKCCRPNLVCSRTHKWCKYVF-{Amide} | [Ala5;Phe6]GpTx-1(1-34) | 0.07 | 5.00 | 2.24 | 0.05 | 32.0 | 48.8 | 1.5 |
| 258 | {H}-DCLGAMRKCIPDNDKCCRPNLVCSRTHKWCKY[1-Nal]F-{Amide} | [Ala5;1-Nal33]GpTx-1(1-34) | 0.38 | 5.00 | 4.83 | 0.80 | 12.6 | 6.0 | 0.5 |
| 259 | {H}-DCLGAMRKC[1-Nal]PDNDKCCRPNLVCSRTHKWCKYVF-{Amide} | [Ala5;1-Nal10]GpTx-1(1-34) | 1.50 | 5.00 | 5.00 | 3.12 | 3.3 | 1.6 | 0.5 |
| 260 | {H}-DCLGAMRKCIPDNDKCCRPNLVCSRTHRWCKYVF-{Amide} | [Ala5;Arg28]GpTx-1(1-34) | 0.33 | 5.00 | 5.00 | 0.24 | 15.2 | 20.6 | 1.4 |
| 261 | {H}-DCLGAWRKCIPDNDKCCRPNLVCSRTHKWCKYVF-{Amide} | [Ala5;Trp6]GpTx-1(1-34) | 1.01 | 5.00 | 5.00 | 0.67 | 5.0 | 7.5 | 1.5 |
| 262 | {H}-DCLGAFRKCIPDNDKCCRPNLVCSRLHRWCKYVF-{Amide} | [Ala5;Phe6;Leu26;Arg28]GpTx-1(1-34) | 0.05 | 5.00 | 5.00 | 0.04 | 110.5 | 131.1 | 1.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 263 | {H}-DCLGAFRKCIPDNDKCCRPNLVCSRLHKWCKYVF-{Amide} | [Ala5;Phe6;Leu26]GpTx-1(1-34) | 0.08 | 5.00 | 5.00 | 0.05 | 63.1 | 105.1 | 1.7 |
| 419 | {H}-DCLGAMRKCIPDNDKCCRPNLVCSRTHKWCKYEF-{Amide} | [Ala5;Glu33]GpTx-1(1-34) | 4.00 | 9.04 | 11.46 | 3.58 | 2.9 | 3.2 | 1.1 |
| 420 | {H}-DCLGAMRKCIPDNDKCCRPNLVCSRTHRWCKY[1-Nal]F-{Amide} | [Ala5;Arg28; 1-Nal33]GpTx-1(1-34) | 0.20 | 7.50 | 12.77 | 0.32 | 62.9 | 39.9 | 0.6 |
| 421 | {H}-DCLGAMRKCIPDNDKCCRP[1-Nal]LVCSRTHKWCKYVF-{Amide} | [Ala5;1-Nal20]GpTx-1(1-34) | 0.16 | 4.42 | 0.25 | 0.25 | 1.6 | 1.0 | 0.6 |
| 422 | {H}-DCLGAMRKCIPDNDKCCRPWLVCSRTHKWCKYVF-{Amide} | [Ala5;Trp20]GpTx-1(1-34) | 0.28 | >5 | >5 | 0.39 | — | — | 0.7 |
| 423 | {H}-DCLGAMRKCIPWNDKCCRPNLVCSRTHKWCKYVF-{Amide} | [Ala5;Trp12]GpTx-1(1-34) | 0.43 | >5 | >5 | 1.09 | — | — | 0.4 |
| 424 | {H}-DCLWAMRKCIPDNDKCCRPNLVCSRTHKWCKYVF-{Amide} | [Trp4;Ala5]GpTx-1(1-34) | 0.49 | >5 | >5 | 1.17 | — | — | 0.4 |
| 425 | {H}-[1-Nal]CLGAMRKCIPDNDKCCRPNLVCSRTHKWCKYVF-{Amide} | [1-Nal1;Ala5]GpTx-1(1-34) | 0.50 | >5 | >5 | 0.77 | — | — | 0.6 |
| 426 | {H}-DCLGAMRKCIPDNDKCCRPNLVCSRTHKWCKYAF-{Amide} | [Ala5,33]GpTx-1(1-34) | 0.58 | >5 | >5 | 1.58 | — | — | 0.4 |
| 427 | {H}-DCLGAMRKCIPD[1-Nal]DKCCRPNLVCSRTHKWCKYVF-{Amide} | [Ala5;1-Nal13]GpTx-1(1-34) | 0.65 | >5 | >5 | 1.18 | — | — | 0.6 |
| 428 | {H}-DCLGAMRKCIPDWDKCCRPNLVCSRTHKWCKYVF-{Amide} | [Ala5;Trp13]GpTx-1(1-34) | 0.67 | >5 | >5 | 1.10 | — | — | 0.6 |
| 429 | {H}-DCLEAMRKCIPDNDKCCRPNLVCSRTHKWCKYVF-{Amide} | [Glu4;Ala5]GpTx-1(1-34) | 4.64 | >5 | >5 | 3.99 | — | — | 1.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 430 | {H}-DCLGAMRKCIPDNDKCCRPNLVCSRTHKWCKYVE-{Amide} | [Ala5;Glu34]GpTx-1(1-34) | >5 | >5 | >5 | >5 | — | — | — |
| 431 | {H}-DCLGAMRKCIPDNDKCCRPNLVCSRTHKWCKYVA-{Amide} | [Ala5,34]GpTx-1(1-34) | >5 | >5 | >5 | >5 | — | — | — |
| 432 | {H}-DCLGAMRKCIPDNDKCCRPNLVCSRTHKWCKAVF-{Amide} | [Ala5,32]GpTx-1(1-34) | >5 | >5 | >5 | >5 | — | — | — |
| 433 | {H}-DCLGAMRKCIPDNDKCCRPNLVCSRTHKWCAYVF-{Amide} | [Ala5,31]GpTx-1(1-34) | >5 | >5 | >5 | >5 | — | — | — |
| 434 | {H}-DCLGAMRKCIPDNDKCCRPNLVCSRTHKACKYVF-{Amide} | [Ala5,29]GpTx-1(1-34) | >5 | >5 | >5 | >5 | — | — | — |
| 435 | {H}-DCLGAMRKCIPDNDKCCRPNLVCSRTHEWCKYVF-{Amide} | [Ala5;Glu28]GpTx-1(1-34) | >5 | 3.66 | 0.23 | >5 | — | — | — |
| 436 | {H}-DCLGAMEKCIPDNDKCCRPNLVCSRTHKWCKYVF-{Amide} | [Ala5;Glu7]GpTx-1(1-34) | >5 | >5 | >5 | >5 | — | — | — |
| 437 | {H}-DCLGAMRKCIPDNDKCCRPNLVCSRTHKECKYVF-{Amide} | [Ala5;Glu29]GpTx-1(1-34) | 11.93 | 9.26 | 22.27 | 6.09 | 1.9 | 3.7 | 2.0 |
| 438 | {H}-DCLGAMRKCIPDNDKCCRPNLVCSETHKWCKYVF-{Amide} | [Ala5;Glu25]GpTx-1(1-34) | 5.50 | 18.21 | 21.08 | 5.95 | 3.8 | 3.5 | 0.9 |
| 439 | {H}-DCLGAMRKCIPDNDECCRPNLVCSRTHKWCKYVF-{Amide} | [Ala5;Glu15]GpTx-1(1-34) | 2.41 | 10.81 | 20.47 | 4.80 | 8.5 | 4.3 | 0.5 |
| 251 | {H}-DCLGFMRKCIPDNDKCCRPNLVCSRTHRWCK[1-Nal]VF-{Amide} | [Arg28;1-Nal32]GpTx-1(1-34) | 0.005 | 2.56 | 0.19 | 0.002 | 35.9 | 112.3 | 3.1 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 440 | {H}-DCLGFMRKC[1-Nal]PDNDKCCRPNLVCSRTHKWCKWVF-{Amide} | [1-Nal10;Trp32]GpTx-1(1-34) | 0.37 | >5 | 4.58 | 0.26 | 12.5 | 17.9 | 1.4 |
| 441 | {H}-DCLGFMRKC[1-Nal]PDNDKCCRPNLVCSRTHRWCKYVF-{Amide} | [1-Nal10;Arg28]GpTx-1(1-34) | 0.02 | >5 | 1.29 | 0.04 | 52.7 | 36.4 | 0.7 |
| 442 | {H}-DCLGFMRKCIPDNDKCCRPNLVCSRTHRWCKY[1-Nal]F-{Amide} | [Arg28;1-Nal33]GpTx-1(1-34) | 0.03 | >5 | 0.60 | 0.04 | 20.2 | 13.6 | 0.7 |
| 443 | {H}-DCLGFMRKCIPDNDKCCRPNLVCSRTHRWCKWVF-{Amide} | [Arg28;Trp32]GpTx-1(1-34) | 0.07 | 4.92 | 2.49 | 0.07 | 38.2 | 35.0 | 0.9 |
| 444 | {H}-DCLGFMRKCIPDNDKCCRPNLVCSRTHRWCKYWF-{Amide} | [Arg28;Trp33]GpTx-1(1-34) | 0.03 | >5 | 0.68 | 0.04 | 19.6 | 18.2 | 0.9 |
| 445 | {H}-DCLGFMRKCIPDNDKCCRPNLVCSRLHRWCKYVF-{Amide} | [Leu26;Arg28]GpTx-1(1-34) | 0.03 | >5 | >5 | 0.06 | — | — | 0.6 |
| 446 | {H}-DCLGFMRKCIPDNDKCCRPNLVCSRLHKWCKWVF-{Amide} | [Leu26;Trp32]GpTx-1(1-34) | 0.04 | >5 | 2.92 | 0.06 | 75.9 | 51.8 | 0.7 |
| 447 | {H}-DCLGFMRKCIPDNDKCCRPNLVCSRLHKWCKYWF-{Amide} | [Leu26;Trp33]GpTx-1(1-34) | 0.03 | >5 | 0.95 | 0.02 | 36.7 | 43.5 | 1.2 |
| 448 | {H}-DCLGFWRKCIPDNDKCCRPNLVCSRTHRWCKYVF-{Amide} | [Trp6;Arg28]GpTx-1(1-34) | 0.01 | 2.91 | 0.33 | 0.01 | 28.7 | 37.9 | 1.3 |
| 449 | {H}-DCLGFWRKCIPDNDKCCRPNLVCSRTHKWCKWVF-{Amide} | [Trp6,32]GpTx-1(1-34) | 0.03 | 2.93 | 0.25 | 0.01 | 8.6 | 29.2 | 3.4 |
| 450 | {H}-DCLGFMRKCIPDNDKCCRPNLVCSRTHKWCKWWF-{Amide} | [Trp32,33]GpTx-1(1-34) | 0.05 | 11.50 | 0.38 | 0.03 | 7.1 | 11.0 | 1.6 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 451 | {H}-DCLGF[1-Nal]RKCIPDNDKCCRPNLVCSRTHKWCKWVF-{Amide} | [1-Nal6;Trp32]GpTx-1(1-34) | 0.004 | >5 | 2.53 | 0.02 | 572.7 | 161.3 | 0.3 |
| 452 | {H}-DCLGFMRKC[1-Nal]PDNDKCCRPNLVCSRTHKWCK[1-Nal]VF-{Amide} | [1-Nal10,32]GpTx-1(1-34) | 0.005 | >5 | 4.51 | 0.003 | 956.6 | 1322.1 | 1.4 |
| 453 | {H}-DCLGFMRKCIPDNDKCCRPNLVCSRLHKWCK[1-Nal]VF-{Amide} | [Leu26;1-Nal32]GpTx-1(1-34) | 0.01 | >5 | 1.69 | 0.01 | 289.5 | 161.2 | 0.6 |
| 454 | {H}-DCLGF[1-Nal]RKCIPDNDKCCRPNLVCSRTHRWCKYVF-{Amide} | [1-Nal6;Arg28]GpTx-1(1-34) | 0.01 | >5 | 4.42 | 0.01 | 732.2 | 661.7 | 0.9 |
| 455 | {H}-DCLGFMRKCIPDNDKCCRPNLVCSRTHKWCKW[1-Nal]F-{Amide} | [Trp32;1-Nal33]GpTx-1(1-34) | 0.02 | >5 | >5 | 0.04 | — | — | 0.6 |
| 456 | {H}-DCLGFWRKCIPDNDKCCRPNLVCSRLHKWCKYVF-{Amide} | [Trp6;Leu26]GpTx-1(1-34) | 0.03 | >5 | 2.91 | 0.01 | 91.6 | 228.8 | 2.5 |
| 457 | {H}-DCLGFMRKC[1-Nal]PDNDKCCRPNLVCSRLHKWCKYVF-{Amide} | [1-Nal10;Leu26]GpTx-1(1-34) | 0.06 | >5 | 2.53 | 0.03 | 44.2 | 76.0 | 1.7 |
| 458 | {H}-DCLGFWRKC[1-Nal]PDNDKCCRPNLVCSRTHKWCKYVF-{Amide} | [Trp6;1-Nal10]GpTx-1(1-34) | 0.06 | >5 | >5 | 0.05 | — | — | 1.2 |
| 459 | {H}-DCLGFMRKC[1-Nal]PWNDKCCRPNLVCSRTHKWCKYVF-{Amide} | [1-Nal10;Trp12]GpTx-1(1-34) | 0.08 | >5 | 0.70 | 0.09 | 8.5 | 7.8 | 0.9 |
| 460 | {H}-DCLGFMRKCIPDNDKCCRPNLVCSRTHKWCK[1-Nal]WF-{Amide} | [1-Nal32;Trp33]GpTx-1(1-34) | 0.08 | >5 | 1.43 | 0.03 | 17.1 | 47.8 | 2.8 |
| 461 | {H}-DCLGFWRKCIPDNDKCCRPNLVCSRTHKWCKY[1-Nal]F-{Amide} | [Trp6;1-Nal33]GpTx-1(1-34) | 0.10 | >5 | 1.38 | 0.05 | 13.4 | 28.5 | 2.1 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 462 | {H}-DCLGFMRKC[1-Nal]PDNDKCCRPNLVCSRTHKWCKY[1-Nal]F-{Amide} | [1-Nal10,33]GpTx-1(1-34) | 0.11 | >5 | 0.88 | 0.07 | 8.2 | 13.0 | 1.6 |
| 463 | {H}-DCLGFMRKCIPDNDKCCRPNLVCSRLHKWCKY[1-Nal]F-{Amide} | [Leu26;1-Nal33]GpTx-1(1-34) | 0.13 | >5 | >5 | 0.18 | — | — | 0.7 |
| 464 | {H}-WDCLGFMRKC[1-Nal]PDNDKCCRPNLVCSRTHKWCKYVF-{Amide} | Trp-[1-Nal10]GpTx-1(1-34) | 0.20 | >5 | 2.61 | 0.22 | 13.1 | 12.0 | 0.9 |
| 465 | {H}-WCLGFMRKC[1-Nal]PDNDKCCRPNLVCSRTHKWCKYVF-{Amide} | [Trp1;1-Nal10]GpTx-1(1-34) | 0.23 | >5 | 1.98 | 0.15 | 8.7 | 13.0 | 1.5 |
| 466 | {H}-[1-Nal]CLGFMRKC[1-Nal]PDNDKCCRPNLVCSRTHKWCKYVF-{Amide} | [1-Nal1,10]GpTx-1(1-34) | 0.61 | >5 | >5 | 0.43 | — | — | 1.4 |
| 467 | {H}-DCLGFMRKCSPDNDKCCRPNLVCSRKHKWCKYEI-{Amide} | GpTx-2 | 4.34 | 7.21 | 11.73 | 1.15 | 2.7 | 10.2 | 3.8 |
| 468 | {H}-DCLGWFKGCDPDNDKCCEGYKCNRRDKWCKYKL-{Amide} | GpTx-3 | 8.93 | 7.80 | 20.00 | 9.37 | 2.2 | 2.1 | 1.0 |
| 469 | {H}-DCLGWFKGCDPDNDKCCENYKCNRREQWCKYKL-{Amide} | GpTx-4 | 9.25 | 10.38 | 11.00 | 4.92 | 1.2 | 2.2 | 1.9 |
| 1 | {H}-DCLGFMRKCIPDNDKCCRPNLVCSRTHKWCKYVF-{Amide} | GpTx-1(1-34) | 0.08 | 13.09 | 1.93 | 0.08 | 24.9 | 22.8 | 0.9 |
| 471 | {H}-DCLGWFKGCDPDNDKCCEGYKCNRRDKWCKYKLWK-{FreeAcid} | GpTx-6(1-35) | 9.6 | 14.6 | 17.4 | 1.7 | 1.8 | 10.0 | 5.5 |
| 472 | {H}-DCLGWFKGCDPDNDKCCEGYKCNRRDKWCKYKLW-{FreeAcid} | GpTx-6(1-34) | 1.3 | 7.3 | 4.1 | 0.54 | 3.2 | 7.6 | 2.4 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 593 | {H}-DCLGFFRKCIPDNDKCCRPNLVCSRTH[Atz(20 kDa PEG)]WCKYVF-{Amide} | [Phe6,Atz(20kDa Peg)28]GpTx-1(1-34) | 3.5 | 15.6 | 13.4 | 4.5 | 3.8 | 3.0 | 0.8 |
| 594 | {H}-DCLGFFRKCIPDNDKCCRPNL[Atz(20kDa PEG)]CSRTHKWCKYVF-{Amide} | [Phe6,Atz(20kDa Peg)22]GpTx-1(1-34) | 3.2 | 11.0 | 12.9 | 5.7 | 4.0 | 2.3 | 0.6 |
| 595 | {H}-DCLGFMRKC[1-Nal]PDNDKCCRPNLVCSRTHKECKYVF-{Amide} | [1-Nal10;Glu29]GpTx-1(1-34) | 9.8 | 18.9 | 11.2 | 10.8 | 1.1 | 1.0 | 0.9 |
| 596 | {H}-DCLG[3Pal]MRKCIPDNDKCCRPNLVCSRTHKWCKYVF-{Amide} | [3Pal5]GpTx-1(1-34) | 2.6 | >5 | >5 | >5 | 1.9 | 1.0 | 0.5 |
| 597 | {H}-DCLGAFRKCIPDYDKCCRPNLVCSRTHRWCKYVF-{FreeAcid} | [Ala5;Phe6;Tyr13;Arg28]GpTx-1(1-34)-FreeAcid | >5 | 7.35 | >5 | 1.1 | — | — | — |
| 598 | {H}-DCLGALRKCIPDNDKCCRPNLVCSRTHGWCKYVF-{FreeAcid} | [Ala5;Leu6;Gly28]GpTx-1(1-34)-FreeAcid | >5 | 12.57 | >5 | 4.0 | — | — | — |
| 599 | {H}-DCLGALRKCIPDNDKCCRPNLVCSRTHHWCKYVF-{FreeAcid} | [Ala5;Leu6;His28]GpTx-1(1-34)-FreeAcid | >5 | 12.65 | >5 | 2.2 | — | — | — |
| 600 | {H}-DCLGALRKCIPDNDKCCRPNLVCSRTHKWCKYVF-{FreeAcid} | [Ala5;Leu6]GpTx-1(1-34)-FreeAcid | >5 | 12.63 | >5 | 3.1 | — | — | — |
| 601 | {H}-DCLGALRKCIPDNDKCCRPNLVCSRTHNWCKYVF-{FreeAcid} | [Ala5;Leu6;Asn28]GpTx-1(1-34)-FreeAcid | >5 | 10.02 | >5 | 2.6 | — | — | — |
| 602 | {H}-DCLGaFRKCIPDNDKCCRPNLVCSRTHKWCKYVF-{Amide} | [D-Ala5;Phe6]GpTx-1(1-34) | 2.1 | 13.1 | 8.1 | 2.7 | 3.8 | 3.0 | 0.8 |
| 603 | {H}-DCLG[bAla]FRKCIPDNDKCCRPNLVCSRTHKWCKYVF-{Amide} | [bAla5;Phe6]GpTx-1(1-34) | 15.3 | 9.5 | 9.1 | 11.8 | 0.6 | 0.8 | 1.3 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 604 | {H}-DCLG[Aib]FRKCIPDNDKCCRPNLVCSRTHKWCKYVF-{Amide} | [Aib5;Phe6]GpTx-1(1-34) | 0.44 | 6.4 | 7.9 | 0.61 | 17.9 | 12.8 | 0.7 |
| 605 | {H}-DCLG[2-Abu]FRKCIPDNDKCCRPNLVCSRTHKWCKYVF-{Amide} | [2-Abu5;Phe6]GpTx-1(1-34) | 0.17 | 9.5 | 5.6 | 0.36 | 33.2 | 15.5 | 0.5 |
| 606 | {H}-DCLG[Nva]FRKCIPDNDKCCRPNLVCSRTHKWCKYVF-{Amide} | [Nva5;Phe6]GpTx-1(1-34) | 0.084 | 7.8 | 2.7 | 0.17 | 32.3 | 16.1 | 0.5 |
| 607 | {H}-DCLG[Nle]FRKCIPDNDKCCRPNLVCSRTHKWCKYVF-{Amide} | [Nle5;Phe6]GpTx-1(1-34) | 0.016 | 11.3 | 1.0 | 0.067 | 64.4 | 15.1 | 0.2 |
| 608 | {H}-DCLG[OctylG]FRKCIPDNDKCCRPNLVCSRTHKWCKYVF-{Amide} | [OctylG5;Phe6]GpTx-1(1-34) | 11.3 | 20.2 | 15.8 | 21.8 | 1.4 | 0.7 | 0.5 |
| 609 | {H}-DCLG[Tle]FRKCIPDNDKCCRPNLVCSRTHKWCKYVF-{Amide} | [Tle5;Phe6]GpTx-1(1-34) | 0.081 | 6.7 | 4.6 | 0.26 | 56.4 | 17.6 | 0.3 |
| 610 | {H}-DCLG[hLeu]FRKCIPDNDKCCRPNLVCSRTHKWCKYVF-{Amide} | [hLeu5;Phe6]GpTx-1(1-34) | 0.011 | 8.2 | 0.76 | 0.041 | 70.1 | 18.7 | 0.3 |
| 611 | {H}-DCLGMFRKCIPDNDKCCRPNLVCSRTHKWCKYVF-{Amide} | [Met5;Phe6]GpTx-1(1-34) | 0.043 | 13.3 | 2.4 | 0.11 | 55.7 | 20.9 | 0.4 |
| 612 | {H}-DCLGLFRKCIPDNDKCCRPNLVCSRTHKWCKYVF-{Amide} | [Leu5;Phe6]GpTx-1(1-34) | 0.057 | 20.1 | 3.4 | 0.22 | 59.8 | 15.6 | 0.3 |
| 613 | {H}-DCLG[3Pal]FRKCIPDNDKCCRPNLVCSRTHKWCKYVF-{Amide} | [3Pal5;Phe6]GpTx-1(1-34) | 0.95 | 18.7 | 21.6 | 3.6 | 22.7 | 5.9 | 0.3 |
| 614 | {H}-DCLG[Thi]FRKCIPDNDKCCRPNLVCSRTHKWCKYVF-{Amide} | [Thi5;Phe6]GpTx-1(1-34) | 0.012 | 4.1 | 1.1 | 0.077 | 88.3 | 14.3 | 0.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 615 | {H}-DCLG[Cpg]FRKCIPDNDKCCRPNLVCSRTHKWCKYVF-{Amide} | [Cpg5;Phe6]GpTx-1(1-34) | 0.035 | 5.6 | 2.0 | 0.12 | 55.9 | 16.7 | 0.3 |
| 616 | {H}-DCLG[Chg]FRKCIPDNDKCCRPNLVCSRTHKWCKYVF-{Amide} | [Chg5;Phe6]GpTx-1(1-34) | 0.023 | 6.9 | 1.2 | 0.075 | 54.0 | 16.6 | 0.3 |
| 617 | {H}-DCLGSFRKCIPDNDKCCRPNLVCSRTHKWCKYVF-{Amide} | [Ser5;Phe6]GpTx-1(1-34) | 0.76 | 11.9 | 13.9 | 1.7 | 18.2 | 8.0 | 0.4 |
| 618 | {H}-DCLGVFRKCIPDNDKCCRPNLVCSRTHKWCKYVF-{Amide} | [Val5;Phe6]GpTx-1(1-34) | 0.12 | 9.4 | 2.3 | 0.099 | 19.1 | 23.3 | 1.2 |
| 619 | {H}-DCLG[4-Bz-F]FRKCIPDNDKCCRPNLVCSRTHKWCKYVF-{Amide} | [4-Bz-F5;Phe6]GpTx-1(1-34) | 0.14 | 7.7 | 0.57 | 0.042 | 4.0 | 13.8 | 3.4 |
| 620 | {H}-DCLG[DiMeO-F]FRKCIPDNDKCCRPNLVCSRTHKWCKYVF-{Amide} | [DiMeO-F5;Phe6]GpTx-1(1-34) | 0.64 | 10.4 | 10.1 | 0.99 | 15.7 | 10.2 | 0.6 |
| 621 | {H}-DCLG[DiCl-F]FRKCIPDNDKCCRPNLVCSRTHKWCKYVF-{Amide} | [DiCl-F5;Phe6]GpTx-1(1-34) | 0.048 | 4.1 | 0.16 | 0.005 | 3.4 | 29.7 | 8.8 |
| 622 | {H}-DCLG[pl-Phe]FRKCIPDNDKCCRPNLVCSRTHKWCKYVF-{Amide} | [pl-Phe5;Phe6]GpTx-1(1-34) | 12.3 | 12.9 | 22.9 | 21.0 | 1.9 | 1.1 | 0.6 |
| 623 | {H}-DCLG[4CF3-F]FRKCIPDNDKCCRPNLVCSRTHKWCKYVF-{Amide} | [4CF3-F5;Phe6]GpTx-1(1-34) | 0.096 | 7.1 | 0.23 | 0.013 | 2.3 | 17.1 | 7.3 |
| 624 | {H}-DCLG[4-F-F]FRKCIPDNDKCCRPNLVCSRTHKWCKYVF-{Amide} | [4-F-F5;Phe6]GpTx-1(1-34) | 0.060 | 11.7 | 0.27 | 0.020 | 4.5 | 13.7 | 3.1 |
| 625 | {H}-DCLG[4-Me-F]FRKCIPDNDKCCRPNLVCSRTHKWCKYVF-{Amide} | [4-Me-F5;Phe6]GpTx-1(1-34) | 0.063 | 6.5 | 0.70 | 0.051 | 11.1 | 13.8 | 1.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 626 | {H}-DCLG[4tBu-F]FRKCIPDNDKCCRPNLVCSRTHKWCKYVF-{Amide} | [4tBu-F5;Phe6]GpTx-1(1-34) | 0.052 | 4.7 | 0.26 | 0.021 | 5.0 | 12.6 | 2.5 |
| 627 | {H}-DCLG[NMeVal]FRKCIPDNDKCCRPNLVCSRTHKWCKYVF-{Amide} | [NMeVal5;Phe6]GpTx-1(1-34) | 0.19 | 6.0 | 4.2 | 0.25 | 22.6 | 16.9 | 0.7 |
| 628 | {H}-DCLG[NMeLeu]FRKCIPDNDKCCRPNLVCSRTHKWCKYVF-{Amide} | [NMeLeu5;Phe6]GpTx-1(1-34) | 0.076 | 8.4 | 1.4 | 0.091 | 17.9 | 15.0 | 0.8 |
| 629 | {H}-DCLG[NMePhe]FRKCIPDNDKCCRPNLVCSRTHKWCKYVF-{Amide} | [NMePhe5;Phe6]GpTx-1(1-34) | 0.077 | 13.6 | 1.3 | 0.095 | 17.3 | 14.0 | 0.8 |
| 630 | {H}-DCLG[2-Cl-F]FRKCIPDNDKCCRPNLVCSRTHKWCKYVF-{Amide} | [2-Cl-F5;Phe6]GpTx-1(1-34) | 0.060 | 5.8 | 0.35 | 0.009 | 5.9 | 38.9 | 6.6 |
| 631 | {H}-DCLG[hPhe]FRKCIPDNDKCCRPNLVCSRTHKWCKYVF-{Amide} | [hPhe5;Phe6]GpTx-1(1-34) | 0.019 | 4.9 | 0.18 | 0.005 | 9.4 | 38.4 | 4.1 |
| 632 | {H}-DCLG[Sar]FRKCIPDNDKCCRPNLVCSRTHKWCKYVF-{Amide} | [Sar5;Phe6]GpTx-1(1-34) | 0.68 | 10.5 | 7.6 | 0.45 | 11.2 | 17.0 | 1.5 |
| 633 | {H}-DCLGaLRKCIPDNDKCCRPNLVCSRTHKWCKYVF-{Amide} | [D-Ala5;Leu6]GpTx-1(1-34) | 10.7 | 7.1 | 10.6 | 11.5 | 1.0 | 0.9 | 0.9 |
| 634 | {H}-DCLG[bAla]LRKCIPDNDKCCRPNLVCSRTHKWCKYVF-{Amide} | [bAla5;Leu6]GpTx-1(1-34) | 9.3 | 14.1 | 22.0 | 18.1 | 2.4 | 1.2 | 0.5 |
| 635 | {H}-DCLG[Aib]LRKCIPDNDKCCRPNLVCSRTHKWCKYVF-{Amide} | [Aib5;Leu6]GpTx-1(1-34) | 0.23 | 14.8 | 14.8 | 0.38 | 64.6 | 39.1 | 0.6 |
| 636 | {H}-DCLG[2-Abu]LRKCIPDNDKCCRPNLVCSRTHKWCKYVF-{Amide} | [2-Abu5;Leu6]GpTx-1(1-34) | 0.29 | 16.7 | 6.8 | 1.0 | 23.8 | 6.7 | 0.3 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 637 | {H}-DCLG[Nva]LRKCIPDNDKCCRPNLVCSRTHKWCKYVF-{Amide} | [Nva5;Leu6]GpTx-1(1-34) | 0.095 | 8.0 | 5.1 | 0.71 | 53.7 | 7.2 | 0.1 |
| 638 | {H}-DCLG[Nle]LRKCIPDNDKCCRPNLVCSRTHKWCKYVF-{Amide} | [Nle5;Leu6]GpTx-1(1-34) | 0.025 | 10.6 | 1.9 | 0.099 | 76.6 | 19.2 | 0.3 |
| 639 | {H}-DCLG[OctylG]LRKCIPDNDKCCRPNLVCSRTHKWCKYVF-{Amide} | [OctylG5;Leu6]GpTx-1(1-34) | 0.015 | 1.7 | 0.11 | 0.033 | 7.8 | 3.5 | 0.4 |
| 640 | {H}-DCLGAFRKCIPD[Pra]DKCCRPNLVCSRLHRWCKYVF-{Amide} | [Ala5,Phe6,Pra13,Leu26,Arg28]GpTx-1(1-34) | 0.103 | >5 | 4.9 | 0.090 | 47.3 | 54.6 | 1.2 |
| 641 | {H}-DCLGMLRKCIPDNDKCCRPNLVCSRTHKWCKYVF-{Amide} | [Met5;Leu6]GpTx-1(1-34) | 0.069 | >5 | 4.4 | 0.24 | 64.7 | 18.5 | 0.3 |
| 642 | {H}-DCLG[3Pal]LRKCIPDNDKCCRPNLVCSRTHKWCKYVF-{Amide} | [3Pal5;Leu6]GpTx-1(1-34) | 1.7 | >5 | >5 | 3.9 | — | — | 0.4 |
| 643 | {H}-DCLGSLRKCIPDNDKCCRPNLVCSRTHKWCKYVF-{Amide} | [Ser5;Leu6]GpTx-1(1-34) | 1.3 | >5 | >5 | 3.2 | — | — | 0.4 |
| 644 | {H}-DCLGVLRKCIPDNDKCCRPNLVCSRTHKWCKYVF-{Amide} | [Val5;Leu6]GpTx-1(1-34) | 0.15 | >5 | >5 | 0.48 | — | — | 0.3 |
| 645 | {H}-DCLG[DiMeO-F]LRKCIPDNDKCCRPNLVCSRTHKWCKYVF-{Amide} | [DiMeO-F5;Leu6]GpTx-1(1-34) | 2.4 | >5 | >5 | 2.6 | — | — | 0.9 |
| 646 | {H}-DCLG[Sar]LRKCIPDNDKCCRPNLVCSRTHKWCKYVF-{Amide} | [Sar5;Leu6]GpTx-1(1-34) | 0.92 | >5 | >5 | 1.7 | — | — | 0.6 |
| 647 | {H}-DCLGaMRKCIPDNDKCCRPNLVCSRTHKWCKYVF-{Amide} | [D-Ala5]GpTx-1(1-34) | 4.5 | >5 | >5 | >5 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 648 | {H}-DCLG[bAla]MRKCIPDNDKCCRPNLVCSRTHKWCKYVF-{Amide} | [bAla5]GpTx-1(1-34) | 4.7 | >5 | >5 | >5 | — | — | — |
| 649 | {H}-DCLG[2-Abu]MRKCIPDNDKCCRPNLVCSRTHKWCKYVF-{Amide} | [2-Abu5]GpTx-1(1-34) | 0.69 | >5 | >5 | 1.3 | — | — | 0.5 |
| 650 | {H}-DCLG[Nva]MRKCIPDNDKCCRPNLVCSRTHKWCKYVF-{Amide} | [Nva5]GpTx-1(1-34) | 0.20 | >5 | >5 | 0.57 | — | — | 0.3 |
| 651 | {H}-DCLG[Nle]MARKCIPDNDKCCRPNLVCSRTHKWCKYVF-{Amide} | [Nle5]GpTx-1(1-34) | 0.077 | >5 | 3.0 | 0.17 | 39.6 | 17.6 | 0.4 |
| 652 | {H}-DCLG[DiMeO-F]MARKCIPDNDKCCRPNLVCSRTHKWCKYVF-{Amide} | [DiMeO-F5]GpTx-1(1-34) | 2.9 | >5 | >5 | 3.6 | — | — | 0.8 |
| 653 | {H}-DCLG[DiCl-F]MARKCIPDNDKCCRPNLVCSRTHKWCKYVF-{Amide} | [DiCl-F5]GpTx-1(1-34) | 0.14 | >5 | 1.2 | 0.069 | 8.8 | 17.7 | 2.0 |
| 654 | {H}-DCLG[4CF3-F]MARKCIPDNDKCCRPNLVCSRTHKWCKYVF-{Amide} | [4CF3-F5]GpTx-1(1-34) | 0.32 | >5 | 1.3 | 0.072 | 4.1 | 18.4 | 4.4 |
| 655 | {H}-DCLG[4-F-F]MARKCIPDNDKCCRPNLVCSRTHKWCKYVF-{Amide} | [4-F-F5]GpTx-1(1-34) | 0.26 | >5 | 1.9 | 0.070 | 7.1 | 26.6 | 3.8 |
| 656 | {H}-DCLG[NMeVal]MARKCIPDNDKCCRPNLVCSRTHKWCKYVF-{Amide} | [NMeVal5]GpTx-1(1-34) | 1.2 | >5 | >5 | 2.5 | — | — | 0.5 |
| 657 | {H}-DCLG[NMePhe]MRKCIPDNDKCCRPNLVCSRTHKWCKYVF-{Amide} | [NMePhe5]GpTx-1(1-34) | 0.36 | >5 | >5 | 0.28 | — | — | 1.3 |
| 658 | {H}-DCLG[Sar]MARKCIPDNDKCCRPNLVCSRTHKWCKYVF-{Amide} | [Sar5]GpTx-1(1-34) | 1.5 | >5 | >5 | 2.0 | — | — | 0.7 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 659 | {H}-DCLG[Tle]LRKCIPDNDKCCRPNLVCSRTHKWCKYVF-{Amide} | [Tle5;Leu6]GpTx-1(1-34) | 0.26 | >5 | >5 | 0.58 | — | — | 0.4 |
| 660 | {H}-DCLG[hLeu]LRKCIPDNDKCCRPNLVCSRTHKWCKYVF-{Amide} | [hLeu5;Leu6]GpTx-1(1-34) | 0.031 | >5 | 0.80 | 0.059 | 25.6 | 13.6 | 0.5 |
| 661 | {H}-DCLGLLRKCIPDNDKCCRPNLVCSRTHKWCKYVF-{Amide} | [Leu5,6]GpTx-1(1-34) | 0.095 | >5 | 3.4 | 0.32 | 36.0 | 10.6 | 0.3 |
| 662 | {H}-DCLG[Thi]LRKCIPDNDKCCRPNLVCSRTHKWCKYVF-{Amide} | [Thi5;Leu6]GpTx-1(1-34) | 0.022 | >5 | 0.93 | 0.068 | 42.7 | 13.6 | 0.3 |
| 663 | {H}-DCLG[Cpg]LRKCIPDNDKCCRPNLVCSRTHKWCKYVF-{Amide} | [Cpg5;Leu6]GpTx-1(1-34) | 0.059 | >5 | 2.2 | 0.24 | 36.6 | 9.1 | 0.2 |
| 664 | {H}-DCLG[Chg]LRKCIPDNDKCCRPNLVCSRTHKWCKYVF-{Amide} | [Chg5;Leu6]GpTx-1(1-34) | 0.019 | >5 | 1.3 | 0.11 | 65.3 | 11.4 | 0.2 |
| 665 | {H}-DCLG[4-Bz-F]LRKCIPDNDKCCRPNLVCSRTHKWCKYVF-{Amide} | [4-Bz-F5;Leu6]GpTx-1(1-34) | 0.23 | >5 | 0.57 | 0.030 | 2.5 | 19.1 | 7.7 |
| 666 | {H}-DCLG[DiCl-F]LRKCIPDNDKCCRPNLVCSRTHKWCKYVF-{Amide} | [DiCl-F5;Leu6]GpTx-1(1-34) | 0.029 | 4.5 | 0.32 | 0.016 | 10.9 | 20.2 | 1.9 |
| 667 | {H}-DCLG[pI-Phe]LRKCIPDNDKCCRPNLVCSRTHKWCKYVF-{Amide} | [pI-Phe5;Leu6]GpTx-1(1-34) | 0.12 | >5 | 0.39 | 0.017 | 3.2 | 23.3 | 7.3 |
| 668 | {H}-DCLG[4CF3-F]LRKCIPDNDKCCRPNLVCSRTHKWCKYVF-{Amide} | [4CF3-F5;Leu6]GpTx-1(1-34) | 0.18 | 4.4 | 0.47 | 0.011 | 2.6 | 42.8 | 16.3 |
| 669 | {H}-DCLG[4-F-F]LRKCIPDNDKCCRPNLVCSRTHKWCKYVF-{Amide} | [4-F-F5;Leu6]GpTx-1(1-34) | 0.091 | >5 | 0.78 | 0.037 | 8.6 | 20.9 | 2.4 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 670 | {H}-DCLG[4-Me-F]LRKCIPDNDKCCRPNLVCSRTHKWCKYVF-{Amide} | [4-Me-F5;Leu6]GpTx-1(1-34) | 0.19 | >5 | 0.99 | 0.055 | 5.2 | 17.9 | 3.4 |
| 671 | {H}-DCLG[4tBu-F]LRKCIPDNDKCCRPNLVCSRTHKWCKYVF-{Amide} | [4tBu-F5;Leu6]GpTx-1(1-34) | 0.14 | >5 | 0.43 | 0.050 | 3.1 | 8.5 | 2.8 |
| 672 | {H}-DCLG[NMeVal]LRKCIPDNDKCCRPNLVCSRTHKWCKYVF-{Amide} | [NMeVal5;Leu6]GpTx-1(1-34) | 0.47 | >5 | >5 | 0.75 | — | — | 0.6 |
| 673 | {H}-DCLG[NMeLeu]LRKCIPDNDKCCRPNLVCSRTHKWCKYVF-{Amide} | [NMeLeu5;Leu6]GpTx-1(1-34) | 0.17 | >5 | >5 | 0.69 | — | — | 0.2 |
| 674 | {H}-DCLG[NMePhe]LRKCIPDNDKCCRPNLVCSRTHKWCKYVF-{Amide} | [NMePhe5;Leu6]GpTx-1(1-34) | 0.24 | >5 | 3.5 | 0.31 | 14.3 | 11.3 | 0.8 |
| 675 | {H}-DCLG[2-Cl-F]LRKCIPDNDKCCRPNLVCSRTHKWCKYVF-{Amide} | [2-Cl-F5;Leu6]GpTx-1(1-34) | 0.066 | >5 | 0.92 | 0.072 | 14.0 | 12.9 | 0.9 |
| 676 | {H}-DCLG[hPhe]LRKCIPDNDKCCRPNLVCSRTHKWCKYVF-{Amide} | [hPhe5;Leu6]GpTx-1(1-34) | 0.016 | >5 | 0.90 | 0.061 | 56.2 | 14.6 | 0.3 |
| 677 | {H}-DCLG[OctylG]MRKCIPDNDKCCRPNLVCSRTHKWCKYVF-{Amide} | [OctylG5]GpTx-1(1-34) | 0.17 | >5 | 0.89 | 0.17 | 5.2 | 5.1 | 1.0 |
| 678 | {H}-DCLG[Tle]MRKCIPDNDKCCRPNLVCSRTHKWCKYVF-{Amide} | [Tle5]GpTx-1(1-34) | 0.70 | >5 | >5 | 1.36 | — | — | 0.5 |
| 679 | {H}-DCLG[hLeu]MRKCIPDNDKCCRPNLVCSRTHKWCKYVF-{Amide} | [hLeu5]GpTx-1(1-34) | 0.086 | >5 | 2.2 | 0.24 | 26.0 | 9.4 | 0.4 |
| 680 | {H}-DCLG[Cha]FRKCIPDNDKCCRPNLVCSRTHKWCKYVF-{Amide} | [Cha5;Phe6]GpTx-1(1-34) | 0.019 | 3.5 | 0.38 | 0.032 | 20.1 | 11.9 | 0.6 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 681 | {H}-DCLG[Cha]LRKCIPDNDKCCRPNLVCSRTHKWCKYVF-{Amide} | [Cha5;Leu6]GpTx-1(1-34) | 0.023 | >5 | 0.86 | 0.079 | 37.9 | 10.9 | 0.3 |
| 682 | {H}-DCLG[Thi]MRKCIPDNDKCCRPNLVCSRTHKWCKYVF-{Amide} | [Thi5]GpTx-1(1-34) | 0.11 | >5 | 2.8 | 0.28 | 26.6 | 10.3 | 0.4 |
| 683 | {H}-DCLG[Cpg]MRKCIPDNDKCCRPNLVCSRTHKWCKYVF-{Amide} | [Cpg5]GpTx-1(1-34) | 0.23 | >5 | >5 | 0.63 | — | — | 0.4 |
| 684 | {H}-DCLG[Chg]MRKCIPDNDKCCRPNLVCSRTHKWCKYVF-{Amide} | [Chg5]GpTx-1(1-34) | 0.13 | >5 | 4.6 | 0.36 | 34.1 | 12.6 | 0.4 |
| 685 | {H}-DCLG[4-Bz-F]MRKCIPDNDKCCRPNLVCSRTHKWCKYVF-{Amide} | [4-Bz-F5]GpTx-1(1-34) | 0.68 | >5 | 3.3 | 0.15 | 4.8 | 21.2 | 4.4 |
| 686 | {H}-DCLG[4-Me-F]MRKCIPDNDKCCRPNLVCSRTHKWCKYVF-{Amide} | [4-Me-F5]GpTx-1(1-34) | 0.49 | >5 | 2.2 | 0.18 | 4.5 | 12.5 | 2.8 |
| 687 | {H}-DCLG[4tBu-F]MRKCIPDNDKCCRPNLVCSRTHKWCKYVF-{Amide} | [4tBu-F5]GpTx-1(1-34) | 0.27 | >5 | 1.2 | 0.13 | 4.5 | 9.4 | 2.1 |
| 688 | {H}-DCLG[NMeLeu]MRKCIPDNDKCCRPNLVCSRTHKWCKYVF-{Amide} | [NMeLeu5]GpTx-1(1-34) | 0.29 | >5 | >5 | 0.73 | — | — | 0.4 |
| 689 | {H}-DCLG[2-Cl-F]MRKCIPDNDKCCRPNLVCSRTHKWCKYVF-{Amide} | [2-Cl-F5]GpTx-1(1-34) | 0.13 | >5 | 1.9 | 0.11 | 14.2 | 18.2 | 1.3 |
| 690 | {H}-DCLG[hPhe]MRKCIPDNDKCCRPNLVCSRTHKWCKYVF-{Amide} | [hPhe5]GpTx-1(1-34) | 0.090 | >5 | 2.3 | 0.18 | 25.8 | 13.0 | 0.5 |
| 691 | {H}-DCLGAMRKCIPDNDKCCRPNLVCSRTHEWCKYVF-{Amide} | [Ala5;Glu28]GpTx-1(1-34) | >5 | >5 | >5 | >5 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 692 | {H}-DCLGAMRKCIPDNDKCCRPNLVCSRTHKWCK[1'NMeW]VF-{Amide} | [Ala5;1'NMeW32]GpTx-1(1-34) | 0.18 | >5 | >5 | 0.63 | — | — | 0.3 |
| 693 | {H}-DCLGMMRKCIPDNDKCCRPNLVCSRTHKWCK[1'NMeW]VF-{Amide} | [Met5;1'NMeW32]GpTx-1(1-34) | 0.046 | >5 | 4.3 | 0.10 | 95.0 | 43.0 | 0.5 |
| 694 | {H}-DCLRMMRKCIPDNDKCCRPNLVCSRTHKWCKYVF-{Amide} | [Arg4;Met5]GpTx-1(1-34) | 0.080 | >5 | >5 | 0.29 | — | — | 0.3 |
| 695 | {H}-DCLGFMRKCIPDNDKCCRSNLVCSRTHKWCK[1'NMeW]VF-{Amide} | [Ser19;1'NMeW32]GpTx-1(1-34) | 0.030 | >5 | 0.88 | 0.030 | 29.1 | 28.9 | 1.0 |
| 696 | {H}-DCLGALRKCIPDNDKCCRPNLVCSRTHKWCKYVF-{Amide} | [Ala5;Leu6]GpTx-1(1-34) | 0.27 | >5 | >5 | 0.75 | — | — | 0.4 |
| 697 | {H}-DCLGAGRKCIPDNDKCCRPNLVCSRTHKWCKYVF-{Amide} | [Ala5;Gly6]GpTx-1(1-34) | 8.1 | >5 | >5 | 4.4 | — | — | 1.8 |
| 698 | {H}-DCLGAYRKCIPDNDKCCRPNLVCSRTHKWCKYVF-{Amide} | [Ala5;Tyr6]GpTx-1(1-34) | 4.4 | >5 | >5 | >5 | — | — | — |
| 699 | {H}-DCLGA[1'NMeW]RKCIPDNDKCCRPNLVCSRTHKWCKYVF-{Amide} | [Ala5;1'NMeW6]GpTx-1(1-34) | 0.34 | >5 | >5 | 0.32 | — | — | 1.1 |
| 700 | {H}-DCLGAMRKCDPDNDKCCRPNLVCSRTHKWCKYVF-{Amide} | [Ala5;Asp10]GpTx-1(1-34) | 0.74 | 35 | >50 | 0.84 | — | — | 0.9 |
| 701 | {H}-DCLGAMRKCDPENDKCCRPNLVCSRTHKWCKYVF-{Amide} | [Ala5;Asp10;Glu12]GpTx-(1-34) | 0.97 | 43 | >50 | 1.5 | — | — | 0.6 |
| 702 | {H}-DCLGAFRKCDPDNDKCCRPNLVCSRTHKWCKYVF-{Amide} | [Ala5;Phe6;Asp10]GpTx-1(1-34) | 0.72 | 43 | >50 | 0.37 | — | — | 1.9 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 703 | {H}-DCLGAFRKCIPENDKCCRPNLVCSRTHKWCKYVF-{Amide} | [Ala5;Phe6;Glu12]GpTx-1(1-34) | 0.61 | 45 | 15 | 0.20 | 23.9 | 73.9 | 3.1 |
| 704 | {H}-DCLGVMRKCIPDNDKCCRPNLVCSRTHEWCKYVF-{Amide} | [Val5;Glu28]GpTx-1(1-34) | 0.99 | 49 | >50 | >5 | — | — | — |
| 705 | {H}-DCLG[Nva]MRKCIPDNDKCCRPNLVCSRTHEWCKYVF-{Amide} | [Nva5;Glu28]GpTx-1(1-34) | 0.43 | 33 | >50 | 3.4 | — | — | 0.1 |
| 706 | {H}-DCLG[2-Abu]MRKCIPDNDKCCRPNLVCSRTHEWCKYVF-{Amide} | [2-Abu5;Glu28]GpTx-1(1-34) | 1.4 | >50 | >50 | >5 | — | — | — |
| 707 | {H}-DCLG[2-Abu]LRKCIPDNDKCCRPNLVCSRTHEWCKYVF-{Amide} | [2-Abu5;Leu6;Glu28]GpTx-1(1-34) | 1.2 | 6 | >50 | >5 | — | — | — |
| 708 | {H}-DCLG[Nva]LRKCIPDNDKCCRPNLVCSRTHEWCKYVF-{Amide} | [Nva5;Leu6;Glu28]GpTx-1(1-34) | 0.37 | 31 | >50 | 2.8 | — | — | 0.1 |
| 709 | {H}-DCLGVLRKCIPDNDKCCRPNLVCSRTHEWCKYVF-{Amide} | [Val5;Leu6;Glu28]GpTx-1(1-34) | 0.74 | 43 | >50 | 4.8 | — | — | 0.2 |
| 710 | {H}-DCLGVMRKCDPDNDKCCRPNLVCSRTHKWCKYVF-{Amide} | [Val5;Asp10]GpTx-1(1-34) | 0.69 | 35 | >50 | 1.3 | — | — | 0.5 |
| 711 | {H}-DCLGVMRKCIPENDKCCRPNLVCSRTHKWCKYVF-{Amide} | [Val5;Glu12]GpTx-1(1-34) | 0.48 | 26 | >50 | 0.75 | — | — | 0.6 |
| 712 | {H}-DCLGVMRKCDPENDKCCRPNLVCSRTHKWCKYVF-{Amide} | [Val5;Asp10;Glu12]GpTx-1(1-34) | 0.46 | 34 | >50 | 1.7 | — | — | 0.3 |
| 713 | {H}-DCLGVMRKCIPDNDKCCRPNLVCS[Cit]THKWCKYVF-{Amide} | [Val5;Cit25]GpTx-1(1-34) | 0.83 | 36 | >50 | 4.2 | — | — | 0.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 714 | {H}-DCLGTMRKCDPDNDKCCRPNLVCSRTHKWCKYVF-{Amide} | [Thr5;Asp10]GpTx-1(1-34) | 1.6 | 48 | >50 | >5 | — | — | — |
| 715 | {H}-DCLGAMRKCIPDNDKCCRPNLVCSRTHGWCKYVF-{Amide} | [Ala5;Gly28]GpTx-1(1-34) | 1.0 | >50 | >50 | >5 | — | — | — |
| 716 | {H}-D[2-Abu]LGAMRKCDPDNDKC[2-Abu]RPNLVCSRTHKWCKYVF-{Amide} | [2-Abu2,17;Ala5;Asp10]GpTx-1(1-34) | 3.7 | 49 | >50 | >5 | — | — | — |
| 717 | {H}-D[2-Abu]LG[Nva]LRKCIPDNDKC[2-Abu]RPNLVCSRTHEWCKYVF-{Amide} | [2-Abu2,17;Nva5;Leu6;Glu28]GpTx-1(1-34) | >5 | >50 | >50 | >5 | — | — | — |
| 718 | {H}-D[2-Abu]LG[2-Abu]LRKCIPDNDKC[2-Abu]RPNLVCSRTHEWCKYVF-{Amide} | [2-Abu2,5,17;Leu6;Glu28]GpTx-1(1-34) | 4.3 | >50 | >50 | >5 | — | — | — |
| 719 | {H}-D[2-Abu]LGALRKCIPDNDKC[2-Abu]RPNLVCSRTHEWCKYVF-{Amide} | [2-Abu2,17;Ala5;Leu6;Glu28]GpTx-1(1-34) | 4.3 | >50 | >50 | >5 | — | — | — |
| 720 | {H}-D[2-Abu]LGVLRKCIPDNDKC[2-Abu]RPNLVCSRTHEWCKYVF-{Amide} | [2-Abu2,17;Val5;Leu6;Glu28]GpTx-1(1-34) | >5 | 33 | >50 | >5 | — | — | — |
| 721 | {H}-DCLGA[Nle]RKCIPDNDKCCRPNLVCSRTHKWCKYVF-{Amide} | [Ala5;Nle6]GpTx-1(1-34) | 0.15 | 45 | >50 | 0.41 | — | — | 0.4 |
| 722 | {H}-DCLGA[Nle]RKCEPDNDKCCRPNLVCSRTHKWCKYVF-{Amide} | [Ala5;Nle6;Glu10]GpTx-1(1-34) | 0.33 | 44 | 48 | 0.48 | 144.9 | 101.0 | 0.7 |
| 723 | {H}-DCLGALRKCEPDNDKCCRPNLVCSRTHKWCKYVF-{Amide} | [Ala5;Leu6;Glu10]GpTx-1(1-34) | 0.38 | >50 | >50 | 1.2 | — | — | 0.3 |
| 724 | {H}-DCLGAFRKCEPDNDKCCRPNLVCSRTHKWCKYVF-{Amide} | [Ala5;Phe6;Glu10]GpTx-1(1-34) | 0.38 | 36 | 41 | 0.32 | 109.5 | 130.1 | 1.2 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 725 | {H}-DCLGA[Nle]RKCIPENDKCCRPNLVCSRTHKWCKYVF-{Amide} | [Ala5;Nle6;Glu12]GpTx-1(1-34) | 0.38 | 47 | >50 | 0.27 | — | — | 1.4 |
| 726 | {H}-DCLGALRKCIPENDKCCRPNLVCSRTHKWCKYVF-{Amide} | [Ala5;Leu6;Glu12]GpTx-1(1-34) | 0.35 | >50 | 49 | 0.58 | 138.2 | 83.4 | 0.6 |
| 727 | {H}-DCLGA[Nle]RKCIPDNDKCCRPNLVCSRTHEWCKYVF-{Amide} | [Ala5;Nle6;Glu28]GpTx-1(1-34) | 0.51 | 34 | 34 | 3.4 | 66.8 | 10.1 | 0.2 |
| 728 | {H}-DCLGALRKCIPDNDKCCRPNLVCSRTHEWCKYVF-{Amide} | [Ala5;Leu6;Glu28]GpTx-1(1-34) | 1.6 | 43 | 41 | 6.6 | 26.7 | 6.3 | 0.2 |
| 729 | {H}-DCLGAFRKCIPDNDKCCRPNLVCSRTHEWCKYVF-{Amide} | [Ala5;Phe6;Glu28]GpTx-1(1-34) | 1.1 | 48 | >50 | 1.8 | — | — | 0.6 |
| 730 | {H}-DCLGA[Nle]RKCIPDNDKCCRPNLVCSATHKWCKYVF-{Amide} | [Ala5,25;Nle6]GpTx-1(1-34) | 0.84 | 47 | 49 | 1.7 | 58.0 | 29.3 | 0.5 |
| 731 | {H}-DCLGALRKCIPDNDKCCRPNLVCSATHKWCKYVF-{Amide} | [Ala5,25;Leu6]GpTx-1(1-34) | 0.60 | 38 | 37 | 2.8 | 61.5 | 13.2 | 0.2 |
| 732 | {H}-DCLGAFRKCIPDNDKCCRPNLVCSATHKWCKYVF-{Amide} | [Ala5,25;Phe6]GpTx-1(1-34) | 0.29 | >50 | 45 | 0.60 | 156.1 | 73.7 | 0.5 |
| 733 | {H}-DCLGA[Nle]RKCIPDNDKCCRPNLVCSETHKWCKYVF-{Amide} | [Ala5;Nle6;Glu25]GpTx-1(1-34) | 1.6 | 33 | 42 | 5.2 | 25.9 | 8.1 | 0.3 |
| 734 | {H}-DCLGALRKCIPDNDKCCRPNLVCSETHKWCKYVF-{Amide} | [Ala5;Leu6;Glu25]GpTx-1(1-34) | 1.8 | 41 | >50 | 9.3 | — | — | 0.2 |
| 735 | {H}-DCLGAFRKCIPDNDKCCRPNLVCSETHKWCKYVF-{Amide} | [Ala5;Phe6;Glu25]GpTx-1(1-34) | 1.5 | 41 | 48 | 3.6 | 32.0 | 13.3 | 0.4 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (µM) | IWQ Use Nav1.5 (µM) | IWQ Use Nav1.4 (µM) | IWQ Use Nav1.3 (µM) | Nav1.4/ Nav1.7 | Nav1.4/ Nav1.3 | Nav1.7/ Nav1.3 |
|---|---|---|---|---|---|---|---|---|---|
| 736 | {H}-DCLGFFRKCIPDND[Pra]CCRPNLVCSRTHKWCKYVF-{Amide} | [Phe6,Pra15]GpTx-1(1-34) | >5 | 32.6 | >50 | >5 | — | — | — |
| 737 | {H}-DCLGAMRKCIPDNDKCCRPNLVCSRTHHWCKYVF-{Amide} | [Ala5;His28]GpTx-1(1-34) | 0.40 | 19.2 | 46.6 | 1.6 | 117.3 | 28.7 | 0.2 |
| 738 | {H}-DCLGAMRKCIPDNDKCCRPNLVCSRTHSWCKYVF-{Amide} | [Ala5;Ser28]GpTx-1(1-34) | 0.65 | 21.9 | >50 | 1.8 | — | — | 0.4 |
| 739 | {H}-DCLGAMRKCIPDNDKCCRPNLVCSRTHQWCKYVF-{Amide} | [Ala5;Gln28]GpTx-1(1-34) | 0.63 | 20.5 | 46.0 | 2.2 | 72.5 | 20.5 | 0.3 |
| 740 | {H}-DCLGAMRKCIPDNDKCCRPNLVCSRTH[3Pal]WCKYVF-{Amide} | [Ala5;3Pal28]GpTx-1(1-34) | 1.5 | 31.1 | 47.6 | >5 | 32.5 | — | — |
| 741 | {H}-DCLGAMRKCIPDNDKCCRPNLVCSRTH[4-aminoF]WCKYVF-{Amide} | [Ala5;4-aminoF28]GpTx-1(1-34) | 1.1 | 24.4 | >50 | 2.3 | — | — | 0.5 |
| 742 | {H}-DCLGAMRKCIPDNDKCCRPNLVCSRTH[K(Ac)]WCKYVF-{Amide} | [Ala5;K(Ac)28]GpTx-1(1-34) | 1.1 | 22.7 | 32.7 | 2.5 | 30.5 | 13.1 | 0.4 |
| 743 | {H}-DCLGAMRKCIPDNDKCCRPNLVCSRTH[SDMA]WCKYVF-{Amide} | [Ala5;SDMA28]GpTx-1(1-34) | 0.22 | 26.5 | 46.5 | 1.1 | 213.8 | 43.1 | 0.2 |
| 744 | {H}-DCLGAMRKCIPDNDKCCRPNLVCSRTH[hArg]WCKYVF-{Amide} | [Ala5;hArg28]GpTx-1(1-34) | 0.47 | 39.7 | >50 | 0.82 | — | — | 0.6 |
| 745 | {H}-DCLGAMRKCIPDNDKCCRPNLVCSRTH[R(Me)]WCKYVF-{Amide} | [Ala5;R(Me)28]GpTx-1(1-34) | 0.25 | 40.0 | >50 | 0.50 | — | — | 0.5 |
| 746 | {H}-DCLGAMRKCIPDNDKCCRPNLVCSRTH[Orn]WCKYVF-{Amide} | [Ala5;Orn28]GpTx-1(1-34) | 0.29 | 20.7 | >50 | 0.76 | — | — | 0.4 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (µM) | IWQ Use Nav1.5 (µM) | IWQ Use Nav1.4 (µM) | IWQ Use Nav1.3 (µM) | Nav1.4/ Nav1.7 | Nav1.4/ Nav1.3 | Nav1.7/ Nav1.3 |
|---|---|---|---|---|---|---|---|---|---|
| 747 | {H}-DCLGAMRKCIPDNDKCCRPNLVCSRTH[Dap]WCKYVF-{Amide} | [Ala5;Dap28]GpTx-1(1-34) | 0.37 | 38.3 | 34.5 | 0.78 | 94.0 | 44.4 | 0.5 |
| 748 | {H}-DCLGAMRKCIPDNDKCCRPNLVCSRTH[Cit]WCKYVF-{Amide} | [Ala5;Cit28]GpTx-1(1-34) | 0.87 | 24.2 | >50 | 2.7 | — | — | 0.3 |
| 749 | {H}-DCLGAMRKCIPDNDKCCRPNLVCSRTH[HCit]WCKYVF-{Amide} | [Ala5;HCit28]GpTx-1(1-34) | 0.79 | 20.3 | 46.4 | 2.3 | 58.6 | 20.1 | 0.3 |
| 750 | {H}-DCLGFMRKCIPDNDKCCRPNLVCSRTHDWCKYVF-{Amide} | [Asp28]GpTx-1(1-34) | 0.73 | 37.9 | 49.6 | 0.77 | 67.8 | 64.1 | 0.9 |
| 751 | {H}-DCLGGVRKCIPDNDKCCRPNLVCSRTHKWCKYVF-{Amide} | [Gly5;Val6]GpTx-1(1-34) | >5 | 25.5 | 49.3 | >5 | — | — | — |
| 752 | {H}-DCLGGIRKCIPDNDKCCRPNLVCSRTHKWCKYVF-{Amide} | [Gly5;Ile6]GpTx-1(1-34) | >5 | 25.4 | 44.7 | >5 | — | — | — |
| 753 | {H}-DCLG[2-Abu][Nle]RKCIPDNDKCCRPNLVCSRTHKWCKYVF-{Amide} | [2-Abu5;Nle6]GpTx-1(1-34) | 0.06 | 40.2 | >50 | 0.16 | — | — | 0.4 |
| 754 | {H}-DCLGGFRKCEPDNDKCCRPNLVCSRTHKWCKYVF-{Amide} | [Gly5;Phe6;Glu10]GpTx-1(1-34) | 0.35 | 34.2 | >50 | 0.33 | — | — | 1.1 |
| 755 | {H}-DCLGGFRKCIPDNDKCCRPNLVCSRTHEWCKYVF-{Amide} | [Gly5;Phe6;Glu28]GpTx-1(1-34) | >5 | 15.3 | >50 | >5 | — | — | — |
| 756 | {4-Pen}-DCLGAFRKCIPD[2-Abu]DKCCRPNLVCSRTHRWCKYVF-{Amide} | 4-Pen-[Ala5;Phe6;2-Abu13;Arg28]GpTx-1(1-34) | 0.18 | 44.4 | >50 | 0.26 | — | — | 0.7 |
| 757 | {4-Pen}-DCLGAFRKCIPD[2-Abu]DKCCRPNLVCSRTHKWCKYVF-{Amide} | 4-Pen-[Ala5;Phe6;2-Abu13]GpTx-1(1-34) | 0.71 | 34.9 | >50 | 0.28 | — | — | 2.5 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 758 | {4-Pen}-DCLG[2-Abu]LRKCIPD[2-Abu]DKCCRPNLVCSRTHKWCKYVF-{Amide} | 4-Pen-[2-Abu5,13;Leu6]GpTx-1(1-34) | 0.46 | 32.7 | 23.7 | 0.69 | 51.8 | 34.5 | 0.7 |
| 759 | {4-Pen}-DCLG[Nva]LRKCIPD[2-Abu]DKCCRPNLVCSRTHRWCKYVF-{Amide} | 4-Pen-[Nva5;Leu6;2-Abu13;Arg28]GpTx-1(1-34) | 0.10 | 46.2 | 28.0 | 0.23 | 270.9 | 121.0 | 0.4 |
| 760 | {4-Pen}-DCLG[Nva]LRKCIPD[2-Abu]DKCCRPNLVCSRTHKWCKYVF-{Amide} | 4-Pen-[Nva5;Leu6;2-Abu13]GpTx-1(1-34) | 0.19 | 35.2 | 27.4 | 0.25 | 145.4 | 109.2 | 0.8 |
| 761 | {H}-DCLGAMRKCIPDNDKCCRPNLVCSRTH[Guf]WCKYVF-{Amide} | [Ala5;Guf28]GpTx-1(1-34) | 0.16 | 26.9 | >50 | 0.63 | — | — | 0.2 |
| 762 | {H}-DCLGAMRKCIPDNDKCCRPNLVCSRTH[Dab]WCKYVF-{Amide} | [Ala5;Dab28]GpTx-1(1-34) | 0.32 | 23.3 | >50 | 0.86 | — | — | 0.4 |
| 763 | {H}-DCLGFMRKCIPDNDKCCRPNLVCSRTHQWCKYVF-{Amide} | [Gln28]GpTx-1(1-34) | 0.19 | 22.7 | >50 | 0.27 | — | — | 0.7 |
| 764 | {H}-DCLGAMRKCIPDNDKCCRPNLVCSRTHFWCKYVF-{Amide} | [Ala5;Phe28]GpTx-1(1-34) | 4.1 | 41.4 | >50 | >5 | — | — | — |
| 765 | {H}-DCLGAMRKCIPDNDKCCRPNLVCSRTHYWCKYVF-{Amide} | [Ala5;Tyr28]GpTx-1(1-34) | 0.79 | 42.0 | 46.8 | 1.4 | 58.8 | 33.2 | 0.6 |
| 766 | {H}-DCLGAMRKCIPDNDKCCRPNLVCSRTHLWCKYVF-{Amide} | [Ala5;Leu28]GpTx-1(1-34) | 1.1 | 49.3 | 36.9 | 2.7 | 33.4 | 13.7 | 0.4 |
| 767 | {H}-DCLGAMRKCIPDNDKCCRPNLVCSRTHNWCKYVF-{Amide} | [Ala5;Asn28]GpTx-1(1-34) | 1.7 | >50 | 43.8 | 3.2 | 25.6 | 13.6 | 0.5 |
| 768 | {H}-DCLGAMRKCIPDNDKCCRPNLVCS[Cit]THKWCKYVF-{Amide} | [Ala5;Cit25]GpTx-1(1-34) | 1.8 | 23.5 | >50 | 3.2 | — | — | 0.6 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 769 | {H}-DCLGAMRKCIPDNDKCCRPNLVCSRTHDWCKYVF-{Amide} | [Ala5;Asp28]GpTx-1(1-34) | >5 | 39.0 | >50 | >5 | — | — | — |
| 770 | {H}-DCLGAMRKCIPDNDKCCRPNLVCSRTHMWCKYVF-{Amide} | [Ala5;Met28]GpTx-1(1-34) | 1.0 | 45.4 | >50 | 4.1 | — | — | 0.3 |
| 771 | {H}-DCLGAMRKCIPDNDKCCRPNLVCSRTH[K(Me)]WCKYVF-{Amide} | [Ala5;K(Me)28]GpTx-1(1-34) | 1.6 | 40.1 | >50 | 1.8 | — | — | 0.9 |
| 772 | {H}-DCLGFMRKCIPDNDKCCRPNLVCSRTH[pS]WCKYVF-{Amide} | [pS28]GpTx-1(1-34) | 0.90 | >50 | >50 | 0.81 | — | — | 1.1 |
| 773 | {H}-DCLGTMRKCDPENDKCCRPNLVCSRTHKWCKYVF-{Amide} | [Thr5;Asp10;Glu12]GpTx-1(1-34) | 4.5 | 28.4 | >50 | 3.4 | — | — | 1.3 |
| 774 | {H}-DCLGFMRKC[1-Nal]PDNDKCCRPNLVCSRTHKWCKYEF-{Amide} | [1-Nal10;Glu33]GpTx-1(1-34) | 0.30 | 28.3 | 12.7 | 0.53 | 42.8 | 24.2 | 0.6 |
| 775 | {H}-DCLGFMRKC[1-Nal]PDNDKCCRPNLVCSRTHKWCKEVF-{Amide} | [1-Nal10;Glu32]GpTx-1(1-34) | >5 | 28.6 | 21.3 | >5 | — | — | — |
| 776 | {H}-DCLGFMRKC[1-Nal]PDNDKCCRPNLVCSRTHKWCEYVF-{Amide} | [1-Nal10;Glu31]GpTx-1(1-34) | >5 | 26.8 | 28.5 | >5 | — | — | — |
| 777 | {H}-DCLGFMRKC[1-Nal]PDNDKCCRPNLVCSRTHKWCKYAF-{Amide} | [1-Nal10;Ala33]GpTx-1(1-34) | 0.20 | 39.5 | 8.6 | 0.20 | 43.7 | 42.4 | 1.0 |
| 778 | {H}-DCLGFMRKC[1-Nal]PDNDKCCRPNLVCSRTHKWCKAVF-{Amide} | [1-Nal10;Ala32]GpTx-1(1-34) | 0.51 | 35.0 | 15.8 | 0.44 | 31.0 | 36.2 | 1.2 |
| 779 | {H}-DCLGFMRKC[1-Nal]PDNDKCCRPNLVCSRTHKWCAYVF-{Amide} | [1-Nal10;Ala31]GpTx-1(1-34) | >5 | 36.5 | 38.0 | 3.2 | — | 12.0 | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 780 | {H}-DCLGFMRKC[1-Nal]PDNDKCCRPNLVCSRTHEWCKYVF-{Amide} | [1-Nal10;Glu28]GpTx-1(1-34) | 0.78 | 27.5 | 28.9 | 1.1 | 37.3 | 26.4 | 0.7 |
| 781 | {H}-DCLGFMRKC[1-Nal]PDNDECCRPNLVCSRTHKWCKYVF-{Amide} | [1-Nal10;Glu15]GpTx-1(1-34) | 0.93 | 34.3 | 24.8 | 1.1 | 26.6 | 21.7 | 0.8 |
| 782 | {H}-DCLGFMREC[1-Nal]PDNDKCCRPNLVCSRTHKWCKYVF-{Amide} | [Glu8;1-Nal10]GpTx-1(1-34) | 1.1 | 30.7 | 12.4 | 1.2 | 11.2 | 10.1 | 0.9 |
| 783 | {H}-DCLEFMRKC[1-Nal]PDNDKCCRPNLVCSRTHKWCKYVF-{Amide} | [Glu4;1-Nal10]GpTx-1(1-34) | 1.3 | 29.1 | 18.5 | 2.0 | 14.1 | 9.1 | 0.6 |
| 784 | {H}-[1-Nal]CLGFMRECIPDNDKCCRPNLVCSRTHKWCKYVF-{Amide} | [1-Nal1;Glu8]GpTx-1(1-34) | 1.0 | 32.0 | 26.0 | 0.90 | 25.9 | 29.0 | 1.1 |
| 785 | {H}-[1-Nal]CLGFMEKCIPDNDKCCRPNLVCSRTHKWCKYVF-{Amide} | [1-Nal1;Glu7]GpTx-1(1-34) | 1.8 | 30.6 | 27.7 | 1.9 | 15.4 | 14.7 | 1.0 |
| 786 | {H}-[1-Nal]CLGFERKCIPDNDKCCRPNLVCSRTHKWCKYVF-{Amide} | [1-Nal1;Glu6]GpTx-1(1-34) | >5 | 26.3 | 33.9 | >5 | — | — | — |
| 787 | {H}-DCLGAMRKCIPDNDKCCRPNLVCSREHKWCKYVF-{Amide} | [Ala5;Glu26]GpTx-1(1-34) | >5 | 27.3 | 24.9 | >5 | — | — | — |
| 788 | {H}-DCLGAMRKCIPDNDKCCRPNLVCSRTEKWCKYVF-{Amide} | [Ala5;Glu27]GpTx-1(1-34) | >5 | 29.7 | 27.1 | >5 | — | — | — |
| 789 | {H}-DCLGAMRKCIPDNDKCCRPNLVCSRTHKWCEYVF-{Amide} | [Ala5;Glu31]GpTx-1(1-34) | >5 | 31.8 | 21.5 | >5 | — | — | — |
| 790 | {H}-DCLGAMRKCIPDNDKCCRPNLVCSRTHKWCKYVFE-{Amide} | [Ala5]GpTx-1(1-34)-Glu | >5 | 28.5 | 25.5 | >5 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 791 | {H}-DCLGA[METO1]RKCIPDNDKCCRPNLVCSRTHKWCKYVF-{Amide} | [Ala5,Met(O)6]GpTx-1 isomer1 | >5 | 39.5 | >50 | >5 | — | — | — |
| 792 | {H}-DCLGA[METO1]RKCIPDNDKCCRPNLVCSRTHKWCKYVF-{Amide} | [Ala5,Met(O)6]GpTx-1 isomer2 | >5 | 49.8 | 43.0 | >5 | — | — | — |
| 793 | {H}-DCLGAFRKCIPD[Pra]DKCCRPNLVCSRTHKWCKYVF-{Amide} | [Ala5;Phe6;Pra13]GpTx-1(1-34) | 0.53 | 28.6 | 12.3 | 0.47 | 23.0 | 26.4 | 1.1 |
| 794 | {H}-DCLGAFRKCIPD[K(Ac-Pra)]DKCCRPNLVCSRTHKWCKYVF-{Amide} | [Ala5;Phe6;K(Ac-Pra)13]GpTx-1(1-34) | 0.89 | 37.8 | >50 | 0.70 | — | — | 1.3 |
| 795 | {H}-DCLGAFRKCIPD[K(Ac-Pra)]DKCCRPNLVCSRTHRWCKYVF-{Amide} | [Ala5;Phe6;K(Ac-Pra)13;Arg28]GpTx-1(1-34) | 0.78 | 24.6 | 18.0 | 0.25 | 23.1 | 70.9 | 3.1 |
| 796 | {H}-DCLGALRKCIPD[Pra]DKCCRPNLVCSRLHRWCKYVF-{Amide} | [Ala5;Leu6,26;Pra13;Arg28]GpTx-1(1-34) | 0.22 | 36.4 | >50 | 0.48 | — | — | 0.5 |
| 797 | {H}-DCLG[2-Abu]LRKCIPD[Pra]DKCCRPNLVCSRTHKWCKYVF-{Amide} | [2-Abu5;Leu6;Pra13]GpTx-1(1-34) | 0.52 | 34.0 | 26.6 | 0.93 | 50.8 | 28.7 | 0.6 |
| 798 | {H}-DCLGAFRKCEPD[Pra]DKCCRPNLVCSRLHRWCKYVF-{Amide} | [Ala5;Phe6;Glu10;Pra13;Leu26;Arg28]GpTx-1(1-34) | 0.54 | 32.2 | >50 | 0.56 | — | — | 1.0 |
| 799 | {H}-DCLG[2-Abu]LRKCIPD[K(Ac-Pra)]DKCCRPNLVCSRTHKWCKYVF-{Amide} | [2-Abu5;Leu6;K(Ac-Pra)13]GpTx-1(1-34) | 0.75 | 28.1 | 48.5 | 0.70 | 65.1 | 69.4 | 1.1 |
| 800 | {H}-DCLGALRKCEPD[Pra]DKCCRPNLVCSRLHRWCKYVF-{Amide} | [Ala5;Leu6,26;Glu10;Pra13;Arg28]GpTx-1(1-34) | 0.70 | >50 | >50 | 1.4 | — | — | 0.5 |
| 801 | {H}-DCLG[2-Abu]LRKCIPD[K(4-Pen)]DKCCRPNLVCSRTHRWCKYVF-{Amide} | [2-Abu5;Leu6;K(4-Pen)13;Arg28]GpTx-1(1-34) | 0.55 | 39.7 | >50 | 0.81 | — | — | 0.7 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 802 | {H}-DCLGALRKCIP[Pra]NDKCCRPNLVCSRLHRWCKYVF-{Amide} | [Ala5;Leu6,26;Pra12;Arg28]GpTx-1(1-34) | 0.26 | >50 | 12.3 | 0.54 | 46.6 | 22.7 | 0.5 |
| 803 | {H}-DCLGAFRKCIP[Pra]NDKCCRPNLVCSRLHRWCKYVF-{Amide} | [Ala5;Phe6;Pra12;Leu26;Arg28]GpTx-1(1-34) | 0.13 | 36.5 | 2.5 | 0.12 | 19.9 | 20.7 | 1.0 |
| 804 | {H}-DCLG[2-Abu]FRKCIPD[K(4-Pen)]DKCCRPNLVCSRTHKWCKYVF-{Amide} | [2-Abu5;Phe6;K(4-Pen)13]GpTx-1(1-34) | 0.50 | >50 | 5.3 | 0.35 | 10.5 | 15.2 | 1.5 |
| 805 | {H}-DCLG[Nva]LRKCIPD[K(4-Pen)]DKCCRPNLVCSRTHRWCKYVF-{Amide} | [Nva5;Leu6;K(4-Pen)13;Arg28]GpTx-1(1-34) | 0.31 | 37.5 | 12.2 | 0.27 | 39.4 | 45.7 | 1.2 |
| 806 | {H}-DCLG[Nva]LRKCIPD[K(4-Pen)]DKCCRPNLVCSRTHKWCKYVF-{Amide} | [Nva5;Leu6;K(4-Pen)13]GpTx-1(1-34) | 0.29 | 34.2 | 8.3 | 0.39 | 28.9 | 21.5 | 0.7 |
| 807 | {4-Pen}-DCLG[2-Abu]LRKCIPD[2-Abu]DKCCRPNLVCSRTHRWCKYVF-{Amide} | 4-Pen-[2-Abu5,13;Leu6;Arg28]GpTx-1(1-34) | 0.54 | 36.8 | >50 | 0.90 | — | — | 0.6 |
| 808 | {H}-DCLG[2-Abu]LRKCIPD[K(4-Pen)]DKCCRPNLVCSRTHEWCKYVF-{Amide} | [2-Abu5;Leu6;K(4-Pen)13;Glu28]GpTx-1(1-34) | 1.8 | >5 | >5 | 4.1 | — | — | 0.4 |
| 809 | {H}-DCLGAFRKCIPDNDKCCRPNLVCSRTHRWCKYVF-{Amide} | [Ala5;Phe6;Arg28]GpTx-1(1-34) | 0.3 | >5 | >5 | 0.3 | — | — | 1.0 |
| 810 | {H}-DCLGALRKCIPDNDKCCRPNLVCSRTHRWCKYVF-{Amide} | [Ala5;Leu6;Arg28]GpTx-1(1-34) | 0.2 | >5 | >5 | 0.2 | — | — | 1.0 |
| 811 | {H}-GSDCLGAFRKCIPDNDKCCRPNLVCSRTHRWCKYVF-{Amide} | Gly-Ser-[Ala5;Phe6;Arg28]GpTx-1(1-34) | 0.3 | >5 | >5 | 0.3 | — | — | 1.0 |
| 812 | {H}-GSDCLGALRKCIPDNDKCCRPNLVCSRTHRWCKYVF-{Amide} | Gly-Ser-[Ala5;Leu6;Arg28]GpTx-1(1-34) | 0.2 | >5 | >5 | 0.2 | — | — | 1.0 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 813 | {H}-DCLGAFRKCIPDNDKCCRPNLVCSRTHRWCKYVFW-{FreeAcid} | [Ala5;Phe6;Arg28]GpTx-1(1-34)-Trp-FreeAcid | >5 | >5 | >5 | >5 | — | — | — |
| 814 | {H}-DCLGALRKCIPDNDKCCRPNLVCSRTHRWCKYVFW-{FreeAcid} | [Ala5;Leu6;Arg28]GpTx-1(1-34)-Trp-FreeAcid | 0.6 | >5 | >5 | 0.6 | — | — | 1.0 |
| 815 | {H}-GSDCLGAFRKCIPDNDKCCRPNLVCSRTHRWCKYVFW-{FreeAcid} | Gly-Ser-[Ala5;Phe6;Arg28]GpTx-1(1-34)-Trp-FreeAcid | >5 | >5 | >5 | >5 | — | — | — |
| 816 | {H}-GSDCLGALRKCIPDNDKCCRPNLVCSRTHRWCKYVFW-{FreeAcid} | Gly-Ser-[Ala5;Leu6;Arg28]GpTx-1(1-34)-Trp-FreeAcid | >5 | >5 | >5 | >5 | — | — | — |
| 817 | {H}-DCLGAFRKCIPDNDKCCRPNLVCSRTHRWCKYVFF-{FreeAcid} | [Ala5;Phe6;Arg28]GpTx-1(1-34)-Phe-FreeAcid | 1.5 | >5 | >5 | 0.5 | — | — | 3.0 |
| 818 | {H}-DCLGALRKCIPDNDKCCRPNLVCSRTHRWCKYVFF-{FreeAcid} | [Ala5;Leu6;Arg28]GpTx-1(1-34)-Phe-FreeAcid | 2.3 | >5 | >5 | 0.8 | — | — | 2.9 |
| 819 | {H}-GSDCLGAFRKCIPDNDKCCRPNLVCSRTHRWCKYVFF-{FreeAcid} | Gly-Ser-[Ala5;Phe6;Arg28]GpTx-1(1-34)-Phe-FreeAcid | 1.5 | >5 | >5 | 0.5 | — | — | 3.0 |
| 820 | {H}-GSDCLGALRKCIPDNDKCCRPNLVCSRTHRWCKYVFF-{FreeAcid} | Gly-Ser-[Ala5;Leu6;Arg28]GpTx-1(1-34)-Phe-FreeAcid | 0.5 | >5 | >5 | 0.5 | — | — | 1.0 |
| 821 | {H}-GSDCLGAFRKCIPDNDKCCRPNLVCSRTHRWCKYVF-{FreeAcid} | Gly-Ser-[Ala5;Phe6;Arg28]GpTx-1(1-34)-FreeAcid | 3.2 | >5 | >5 | 3.2 | — | — | 1.0 |
| 822 | {H}-GSDCLGALRKCIPDNDKCCRPNLVCSRTHRWCKYVF-{FreeAcid} | Gly-Ser-[Ala5;Leu6;Arg28]GpTx-1(1-34)-FreeAcid | 3.7 | >5 | >5 | 3.7 | — | — | 1.0 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 823 | {H}-DCLGAFRKCIPDNDKCCRPNLVCSRTHRWCKYVF-{FreeAcid} | [Ala5;Phe6;Arg28]GpTx-1(1-34)-FreeAcid | 3.4 | >5 | >5 | 3.4 | — | — | 1.0 |
| 824 | {H}-DCLGAFRKCIPDNDKCCRPNLVCSRTHAWCKYVF-{FreeAcid} | [Ala5,28;Phe6]GpTx-1(1-34)-FreeAcid | >5 | >5 | >5 | >5 | — | — | — |
| 825 | {H}-DCLGAFRKCIPDNDKCCRPNLVCSRTHDWCKYVF-{FreeAcid} | [Ala5;Phe6;Asp28]GpTx-1(1-34)-FreeAcid | >5 | >5 | >5 | >5 | — | — | — |
| 826 | {H}-DCLGAFRKCIPDNDKCCRPNLVCSRTHEWCKYVF-{FreeAcid} | [Ala5;Phe6;Glu28]GpTx-1(1-34)-FreeAcid | >5 | >5 | >5 | 1.8 | — | — | — |
| 827 | {H}-DCLGAFRKCIPDNDKCCRPNLVCSRTHGWCKYVF-{FreeAcid} | [Ala5;Phe6;Gly28]GpTx-1(1-34)-FreeAcid | >5 | >5 | >5 | >5 | — | — | — |
| 828 | {H}-DCLGAFRKCIPDNDKCCRPNLVCSRTHHWCKYVF-{FreeAcid} | [Ala5;Phe6;His28]GpTx-1(1-34)-FreeAcid | >5 | >5 | >5 | >5 | — | — | — |
| 829 | {H}-DCLGAFRKCIPDNDKCCRPNLVCSRTHKWCKYVF-{FreeAcid} | [Ala5;Phe6]GpTx-1(1-34)-FreeAcid | >5 | >5 | >5 | 2.3 | — | — | — |
| 830 | {H}-DCLGAFRKCIPDNDKCCRPNLVCSRTHLWCKYVF-{FreeAcid} | [Ala5;Phe6;Leu28]GpTx-1(1-34)-FreeAcid | >5 | >5 | >5 | >5 | — | — | — |
| 831 | {H}-DCLGAFRKCIPDNDKCCRPNLVCSRTHMWCKYVF-{FreeAcid} | [Ala5;Phe6;Met28]GpTx-1(1-34)-FreeAcid | >5 | >5 | >5 | 1.6 | — | — | — |
| 832 | {H}-DCLGAFRKCIPDNDKCCRPNLVCSRTHNWCKYVF-{FreeAcid} | [Ala5;Phe6;Asn28]GpTx-1(1-34)-FreeAcid | >5 | >5 | >5 | 4.6 | — | — | — |
| 833 | {H}-DCLGAFRKCIPDNDKCCRPNLVCSRTHPWCKYVF-{FreeAcid} | [Ala5;Phe6;Pro28]GpTx-1(1-34)-FreeAcid | >5 | >5 | >5 | >5 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (µM) | IWQ Use Nav1.5 (µM) | IWQ Use Nav1.4 (µM) | IWQ Use Nav1.3 (µM) | Nav1.4/ Nav1.7 | Nav1.4/ Nav1.3 | Nav1.7/ Nav1.3 |
|---|---|---|---|---|---|---|---|---|---|
| 834 | {H}-DCLGAFRKCIPDNDKCCRPNLVCSRTHQWCKYVF-{FreeAcid} | [Ala5;Phe6;Gln28]GpTx-1(1-34)-FreeAcid | >5 | >5 | >5 | 3.9 | — | — | — |
| 835 | {H}-DCLGAFRKCIPDNDKCCRPNLVCSRTHSWCKYVF-{FreeAcid} | [Ala5;Phe6;Ser28]GpTx-1(1-34)-FreeAcid | >5 | >5 | >5 | >5 | — | — | — |
| 836 | {H}-DCLGAFRKCIPDADKCCRPNLVCSRTHRWCKYVF-{FreeAcid} | [Ala5,13;Phe6;Arg28]GpTx-1(1-34)-FreeAcid | 4.1 | >5 | >5 | 1.3 | — | — | 3.1 |
| 837 | {H}-DCLGAFRKCIPDDDKCCRPNLVCSRTHRWCKYVF-{FreeAcid} | [Ala5;Phe6;Asp13;Arg28]GpTx-1(1-34)-FreeAcid | >5 | >5 | >5 | 2.3 | — | — | — |
| 838 | {H}-DCLGAFRKCIPDEDKCCRPNLVCSRTHRWCKYVF-{FreeAcid} | [Ala5;Phe6;Glu13;Arg28]GpTx-1(1-34)-FreeAcid | >5 | >5 | >5 | 1.9 | — | — | — |
| 839 | {H}-DCLGAFRKCIPDFDKCCRPNLVCSRTHRWCKYVF-{FreeAcid} | [Ala5;Phe6,13;Arg28]GpTx-1(1-34)-FreeAcid | >5 | >5 | >5 | 1.2 | — | — | — |
| 840 | {H}-DCLGAFRKCIPDGDKCCRPNLVCSRTHRWCKYVF-{FreeAcid} | [Ala5;Phe6;Gly13;Arg28]GpTx-1(1-34)-FreeAcid | >5 | >5 | >5 | 1.5 | — | — | — |
| 841 | {H}-DCLGAFRKCIPDHDKCCRPNLVCSRTHRWCKYVF-{FreeAcid} | [Ala5;Phe6;His13;Arg28]GpTx-1(1-34)-FreeAcid | >5 | >5 | >5 | >5 | — | — | — |
| 842 | {H}-DCLGAFRKCIPDIDKCCRPNLVCSRTHRWCKYVF-{FreeAcid} | [Ala5;Phe6;Ile13;Arg28]GpTx-1(1-34)-FreeAcid | >5 | >5 | >5 | 3.0 | — | — | — |
| 843 | {H}-DCLGAFRKCIPDKDKCCRPNLVCSRTHRWCKYVF-{FreeAcid} | [Ala5;Phe6;Lys13;Arg28]GpTx-1(1-34)-FreeAcid | 3.6 | 2.8 | >5 | 0.3 | — | — | 11.8 |
| 844 | {H}-DCLGAFRKCIPDLDKCCRPNLVCSRTHRWCKYVF-{FreeAcid} | [Ala5;Phe6;Leu13;Arg28]GpTx-1(1-34)-FreeAcid | 4.5 | >5 | >5 | 4.5 | — | — | 1.0 |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 845 | {H}-DCLGAFRKCIPDMDKCCRPNLVCSRTHRWCKYVF-{FreeAcid} | [Ala5;Phe6;Met13;Arg28]GpTx-1(1-34)-FreeAcid | 4.7 | >5 | >5 | 0.8 | — | — | 5.8 |
| 846 | {H}-DCLGAFRKCIPDPDKCCRPNLVCSRTHRWCKYVF-{FreeAcid} | [Ala5;Phe6;Pro13;Arg28]GpTx-1(1-34)-FreeAcid | 2.9 | >5 | >5 | 2.9 | — | — | 1.0 |
| 847 | {H}-DCLGAFRKCIPDQDKCCRPNLVCSRTHRWCKYVF-{FreeAcid} | [Ala5;Phe6;Gln13;Arg28]GpTx-1(1-34)-FreeAcid | >5 | >5 | >5 | 1.7 | — | — | — |
| 848 | {H}-DCLGAFRKCIPDRDKCCRPNLVCSRTHRWCKYVF-{FreeAcid} | [Ala5;Phe6;Arg13,28]GpTx-1(1-34)-FreeAcid | 4.5 | >5 | >5 | 0.6 | — | — | 7.1 |
| 849 | {H}-DCLGAFRKCIPDSDKCCRPNLVCSRTHRWCKYVF-{FreeAcid} | [Ala5;Phe6;Ser13;Arg28]GpTx-1(1-34)-FreeAcid | >5 | >5 | >5 | 1.1 | — | — | — |
| 850 | {H}-DCLGAFRKCIPDTDKCCRPNLVCSRTHRWCKYVF-{FreeAcid} | [Ala5;Phe6;Thr13;Arg28]GpTx-1(1-34)-FreeAcid | >5 | >5 | >5 | 1.3 | — | — | — |
| 851 | {H}-DCLGAFRKCIPDVDKCCRPNLVCSRTHRWCKYVF-{FreeAcid} | [Ala5;Phe6;Val13;Arg28]GpTx-1(1-34)-FreeAcid | >5 | >5 | >5 | 1.7 | — | — | — |
| 852 | {H}-DCLGAFRKCIPDWDKCCRPNLVCSRTHRWCKYVF-{FreeAcid} | [Ala5;Phe6;Trp13;Arg28]GpTx-1(1-34)-FreeAcid | >5 | >5 | >5 | >5 | — | — | — |
| 853 | {H}-DCLGALRKCIPDNDKCCRPNLVCSRTHRWCKYVF-{FreeAcid} | [Ala5;Leu6;Arg28]GpTx-1(1-34)-FreeAcid | >5 | >5 | >5 | >5 | — | — | — |
| 854 | {H}-DCLGALRKCIPDNDKCCRPNLVCSRTHDWCKYVF-{FreeAcid} | [Ala5;Leu6;Asp28]GpTx-1(1-34)-FreeAcid | >5 | >5 | >5 | >5 | — | — | — |
| 855 | {H}-DCLGALRKCIPDNDKCCRPNLVCSRTHEWCKYVF-{FreeAcid} | [Ala5;Leu6;Glu28]GpTx-1(1-34)-FreeAcid | >5 | >5 | >5 | >5 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (μM) | IWQ Use Nav1.5 (μM) | IWQ Use Nav1.4 (μM) | IWQ Use Nav1.3 (μM) | Nav1.4/ Nav1.7 | Nav1.4/ Nav1.3 | Nav1.7/ Nav1.3 |
|---|---|---|---|---|---|---|---|---|---|
| 856 | {H}-DCLGALRKCIPDNDKCCRPNLVCSRTHLWCKYVF-{FreeAcid} | [Ala5;Leu6,28]GpTx-1(1-34)-FreeAcid | 4.1 | >5 | >5 | 4.1 | — | — | 1.0 |
| 857 | {H}-DCLGALRKCIPDNDKCCRPNLVCSRTHMWCKYVF-{FreeAcid} | [Ala5;Leu6;Met28]GpTx-1(1-34)-FreeAcid | >5 | >5 | >5 | >5 | — | — | — |
| 858 | {H}-DCLGALRKCIPDNDKCCRPNLVCSRTHQWCKYVF-{FreeAcid} | [Ala5;Leu6;Gln28]GpTx-1(1-34)-FreeAcid | >5 | >5 | >5 | >5 | — | — | — |
| 859 | {H}-DCLGALRKCIPDNDKCCRPNLVCSRTHSWCKYVF-{FreeAcid} | [Ala5;Leu6;Ser28]GpTx-1(1-34)-FreeAcid | >5 | >5 | >5 | >5 | — | — | — |
| 860 | {H}-DCLGALRKCIPDADKCCRPNLVCSRTHRWCKYVF-{FreeAcid} | [Ala5,13;Leu6;Arg28]GpTx-1(1-34)-FreeAcid | >5 | >5 | >5 | 4.5 | — | — | — |
| 861 | {H}-DCLGALRKCIPDDDKCCRPNLVCSRTHRWCKYVF-{FreeAcid} | [Ala5;Leu6;Asp13;Arg28]GpTx-1(1-34)-FreeAcid | >5 | >5 | >5 | >5 | — | — | — |
| 862 | {H}-DCLGALRKCIPDEDKCCRPNLVCSRTHRWCKYVF-{FreeAcid} | [Ala5;Leu6;Glu13;Arg28]GpTx-1(1-34)-FreeAcid | >5 | >5 | >5 | >5 | — | — | — |
| 863 | {H}-DCLGALRKCIPDFDKCCRPNLVCSRTHRWCKYVF-{FreeAcid} | [Ala5;Leu6;Phe13;Arg28]GpTx-1(1-34)-FreeAcid | >5 | >5 | >5 | >5 | — | — | — |
| 864 | {H}-DCLGALRKCIPDHDKCCRPNLVCSRTHRWCKYVF-{FreeAcid} | [Ala5;Leu6;His13;Arg28]GpTx-1(1-34)-FreeAcid | >5 | >5 | >5 | 3.9 | — | — | — |
| 865 | {H}-DCLGALRKCIPDIDKCCRPNLVCSRTHRWCKYVF-{FreeAcid} | [Ala5;Leu6;Ile13;Arg28]GpTx-1(1-34)-FreeAcid | >5 | >5 | >5 | >5 | — | — | — |
| 866 | {H}-DCLGALRKCIPDKDKCCRPNLVCSRTHRWCKYVF-{FreeAcid} | [Ala5;Leu6;Lys13;Arg28]GpTx-1(1-34)-FreeAcid | >5 | >5 | >5 | 2.3 | — | — | — |

TABLE 29-continued

Electrophysiology by IonWorks ® Quattro patch clamp system: Substitutions, additions or deletions at multiple positions relative to SEQ ID NO: 1.

| SEQ ID NO. | Amino Acid Sequence | Designation | IWQ Use Nav1.7 (µM) | IWQ Use Nav1.5 (µM) | IWQ Use Nav1.4 (µM) | IWQ Use Nav1.3 (µM) | Nav1.4/ Nav1.7 | Nav1.4/ Nav1.3 | Nav1.7/ Nav1.3 |
|---|---|---|---|---|---|---|---|---|---|
| 867 | {H}-DCLGALRKCIPDLDKCCRPNLVCSRTHRWCKYVF-{FreeAcid} | [Ala5;Leu6,13;Arg28]GpTx-1(1-34)-FreeAcid | >5 | >5 | >5 | 4.9 | — | — | — |
| 868 | {H}-DCLGALRKCIPDMDKCCRPNLVCSRTHRWCKYVF-{FreeAcid} | [Ala5;Leu6;Met13;Arg28]GpTx-1(1-34)-FreeAcid | >5 | >5 | >5 | >5 | — | — | — |
| 869 | {H}-DCLGALRKCIPDQDKCCRPNLVCSRTHRWCKYVF-{FreeAcid} | [Ala5;Leu6;Gln13;Arg28]GpTx-1(1-34)-FreeAcid | >5 | >5 | >5 | >5 | — | — | — |
| 870 | {H}-DCLGALRKCIPDRDKCCRPNLVCSRTHRWCKYVF-{FreeAcid} | [Ala5;Leu6;Arg13,28]GpTx-1(1-34)-FreeAcid | >5 | >5 | >5 | 1.4 | — | — | — |
| 871 | {H}-DCLGALRKCIPDSDKCCRPNLVCSRTHRWCKYVF-{FreeAcid} | [Ala5;Leu6;Ser13;Arg28]GpTx-1(1-34)-FreeAcid | >5 | >5 | >5 | >5 | — | — | — |
| 872 | {H}-DCLGALRKCIPDVDKCCRPNLVCSRTHRWCKYVF-{FreeAcid} | [Ala5;Leu6;Val13;Arg28]GpTx-1(1-34)-FreeAcid | >5 | >5 | >5 | >5 | — | — | — |
| 873 | {H}-DCLGALRKCIPDYDKCCRPNLVCSRTHRWCKYVF-{FreeAcid} | [Ala5;Leu6;Tyr13;Arg28]GpTx-1(1-34)-FreeAcid | 4.8 | >5 | >5 | >5 | — | — | — |

TABLE 30

| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
|---|---|---|---|---|---|---|---|---|---|---|
| Electrophysiology by PatchXpress ® patch clamp system | | | | | | | | | | |
| 1 | GpTx-1(1-34) | 0.010 | 0.241 | >10 | 0.005 | 24 | >1000 | 48 | >2000 | 2.0 |
| 528 | Huwentoxin-IV | 0.022 | 4.5 | 25.3 | 0.032 | 205 | 1150 | 141 | 791 | 0.7 |
| 529 | Huwentoxin-I | 0.905 | 24.89 | >30 | 0.717 | 28 | 33 | 35 | 42 | 1.3 |
| 530 | KIIIA | 0.574 | 0.021 | | 0.144 | 0 | 0 | 0 | 0 | 4.0 |
| 531 | ProTxII | 0.015 | 0.032 | 0.104 | 0.002 | 2 | 7 | 13 | 43 | 6.3 |
| 72 | [Arg28]GpTx-1(1-34) | 0.012 | 0.866 | 8.730 | 0.007 | 72 | 728 | 124 | 1247 | 1.7 |
| 22 | [Ala5]GpTx-1(1-34) | 0.129 | 4.460 | >10 | 0.018 | 35 | >78 | 248 | >556 | 7.2 |
| 80 | [1-Nal34]GpTx-1(1-34) | 0.007 | 0.179 | 1.860 | 0.004 | 26 | 266 | 45 | 465 | 1.8 |
| 70 | [Arg26]GpTx-1(1-34) | 0.010 | 0.109 | 0.573 | 0.005 | 11 | 57 | 22 | 115 | 2.0 |
| 87 | GpTx-1(1-34)-Trp | 0.015 | 0.640 | 2.660 | 0.009 | 43 | 177 | 71 | 296 | 1.7 |
| 95 | [Gln33]GpTx-1(1-34) | 0.010 | 0.286 | 8.250 | 0.006 | 29 | 825 | 48 | 1375 | 1.7 |
| 77 | [1-Nal1]GpTx-1(1-34) | 0.066 | 0.439 | 7.6 | 0.023 | 7 | 115 | 19 | 330 | 2.9 |
| 78 | [1-Nal10]GpTx-1(1-34) | 0.039 | 0.402 | 12.91 | 0.005 | 10 | 331 | 80 | 2581 | 7.8 |
| 89 | [Phe6]GpTx-1(1-34) | 0.016 | 0.141 | 3.159 | 0.015 | 9 | 197 | 9 | 211 | 1.1 |
| 94 | [Lys26;Thr27]GpTx-1(1-34) | 0.016 | 0.462 | 1.393 | 0.004 | 29 | 87 | 116 | 348 | 4.0 |
| 121 | [Leu26]GpTx-1(1-34) | 0.023 | 0.508 | 5.008 | 0.003 | 22 | 218 | 169 | 1669 | 7.7 |
| 123 | [Nle6]GpTx-1(1-34) | 0.009 | 0.066 | 1.149 | 0.008 | 7 | 124 | 8 | 137 | 1.1 |
| 161 | [1-Nal6]GpTx-1(1-34) | 0.004 | 0.115 | 0.358 | 0.003 | 28 | 87 | 41 | 128 | 1.5 |
| 167 | [1-Nal32]GpTx-1(1-34) | 0.012 | 0.061 | 0.988 | 0.004 | 5 | 82 | 15 | 247 | 3.0 |
| 170 | [Trp6]GpTx-1(1-34) | ND | 0.234 | 3.674 | 0.022 | — | — | 10 | 164 | 0.0 |
| 177 | [Trp22]GpTx-1(1-34) | ND | 0.689 | 4.779 | 0.039 | — | — | 18 | 122 | 0.0 |
| 180 | [Trp33]GpTx-1(1-34) | ND | 0.096 | 2.350 | 0.018 | — | — | 6 | 134 | 0.0 |
| 33 | [Glu33]GpTx-1(1-34) | 0.052 | 2.753 | >10 | 0.027 | 53 | 192 | 102 | 370 | 1.9 |
| 148 | [Glu18]GpTx-1(1-34) | 0.098 | 1.635 | >10 | 0.018 | 17 | >102 | 91 | >556 | 5.4 |
| 242 | [Bip5]GpTx-1(1-34) | 0.003 | 0.103 | 2.077 | 0.062 | 34 | 692 | 2 | 34 | 0.05 |
| 243 | [Cha5]GpTx-1(1-34) | 0.007 | 0.126 | 3.389 | 0.003 | 18 | 484 | 42 | 1130 | 2.3 |
| 244 | [Leu6]GpTx-1(1-34) | 0.018 | 0.365 | >10 | 0.026 | 20 | 556 | 14 | 385 | 0.7 |
| 245 | [Cha6]GpTx-1(1-34) | 0.002 | 0.092 | 2.678 | 0.003 | 46 | 1339 | 31 | 893 | 0.7 |
| 246 | [1'NMeW32]GpTx-1(1-34) | 0.018 | 0.154 | 6.849 | 0.006 | 9 | 381 | 26 | 1142 | 3.0 |
| 152 | [Glu26]GpTx-1(1-34) | 0.216 | 6.41 | >10 | 0.052 | 30 | 46 | 123 | 192 | 4.2 |
| 174 | [Trp18]GpTx-1(1-34) | 0.042 | 1.46 | >10 | 0.024 | 35 | >238 | 61 | >417 | 1.8 |
| 247 | [pI-Phe5]GpTx-1(1-34) | 0.090 | 1.1 | >10 | 0.247 | 12 | 111 | 4 | 40 | 0.36 |
| 248 | [Ile33]GpTx-1(1-34) | 0.102 | 1.94 | >10 | 0.037 | 19 | 98 | 52 | 270 | 2.8 |
| 249 | [pI-Phe33]GpTx-1(1-34) | 0.035 | 0.388 | 10.4 | 0.026 | 11 | 297 | 15 | 400 | 1.3 |
| 250 | [1'NMeW33]GpTx-1(1-34) | 0.037 | 0.396 | 9.54 | 0.054 | 11 | 258 | 7 | 177 | 0.7 |
| 251 | [Arg28;1-Nal32]GpTx-1(1-34) | 0.006 | 0.193 | 1.06 | 0.005 | 32 | 177 | 39 | 212 | 1.2 |
| 108 | GpTx-1(2-34) | 0.015 | 0.251 | 4.944 | 0.007 | 17 | 334 | 36 | 706 | 2.1 |
| 132 | Ac-GpTx-1(1-34) | 0.084 | 2.12 | >10 | 0.013 | 25 | >119 | 163 | >769 | 6.5 |
| 252 | [Ala5;Trp33]GpTx-1(1-34) | 0.569 | 5.54 | >10 | 0.034 | 10 | >18 | 163 | >294 | 16.7 |
| 253 | [Ala5;Trp32]GpTx-1(1-34) | 2.98 | >10 | >10 | 0.103 | 3 | >3 | 97 | >97 | 28.9 |
| 254 | [Ala5;1-Nal32]GpTx-1(1-34) | 0.122 | 2.8 | >10 | 0.028 | 23 | >82 | 100 | >357 | 4.4 |
| 255 | [Ala5;Leu26]GpTx-1(1-34) | 0.47 | >10 | >10 | 0.049 | 21 | >21 | 204 | >204 | 9.6 |
| 256 | [Ala5;1-Nal6]GpTx-1(1-34) | 0.008 | 0.469 | 3.81 | 0.002 | 59 | 476 | 235 | 1905 | 4.0 |
| 257 | [Ala5;Phe6]GpTx-1(1-34) | 0.022 | 0.824 | >10 | 0.012 | 37 | >455 | 69 | >833 | 1.8 |
| 22 | [Ala5]GpTx-1(1-34) | 0.158 | 11.14 | >10 | 0.014 | 70 | >63 | 795 | >714 | 11.3 |
| 258 | [Ala5;1-Nal33]GpTx-1(1-34) | 0.201 | 2.95 | >10 | 0.048 | 15 | >50 | 61 | >208 | 4.2 |
| 259 | [Ala5;1-Nal10]GpTx-1(1-34) | 0.482 | >10 | >10 | 0.097 | 21 | >21 | 103 | >103 | 5.0 |
| 260 | [Ala5;Arg28]GpTx-1(1-34) | 0.44 | >10 | >10 | 0.077 | 23 | >23 | 130 | >130 | 5.7 |
| 261 | [Ala5;Trp6]GpTx-1(1-34) | 0.081 | 6.11 | >10 | 0.057 | 75 | >123 | 107 | >175 | 1.4 |
| 262 | [Ala5;Phe6;Leu26;Arg28]GpTx-1(1-34) | 0.008 | 1.895 | >10 | 0.002 | 237 | >1250 | 948 | >5000 | 4.0 |
| 263 | [Ala5;Phe6;Leu26]GpTx-1(1-34) | 0.011 | 1.196 | >10 | 0.004 | 109 | >909 | 299 | >2500 | 2.8 |

TABLE 30-continued

Electrophysiology by PatchXpress ® patch clamp system

| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
|---|---|---|---|---|---|---|---|---|---|---|
| 515 | [Phe6; Atz(amino-PEG10)13]GpTx-1(1-34) | 0.006 | 0.127 | 5.998 | 0.022 | 21 | 1000 | 6 | 273 | 0.3 |
| 590 | [Phe6;Atz(20kDaPEG)13]GpTx-1(1-34) | 0.232 | 7.98 | >10 | 0.184 | 34 | >43 | 43 | >54 | 1.3 |
| — | [Phe6,Atz(2 kDa EtO-PEG*-{[Phe6,Atz13*]GpTx-1(1-34)})13]GpTx-1(1-34); * = Et (Homodimeric Conjugate 1) | 0.008 | 0.254 | 1.43 | 0.013 | 32 | 179 | 20 | 110 | 0.6 |
| — | [Phe6,Atz(EtO-PEG4*-{[Phe6,Atz13*]GpTx-1(1-34)})13]GpTx-1(1-34); * = Et (Homodimeric Conjugate 2) | 0.046 | 0.299 | 0.863 | 0.019 | 7 | 19 | 16 | 45 | 2.4 |
| 19 | [Glu3]GpTx-1(1-34) | — | 3.81 | >10 | 0.041 | — | — | 93 | >244 | — |
| 21 | [Ala3]GpTx-1(1-34) | — | 0.569 | >10 | 0.012 | — | — | 47 | >833 | — |
| 63 | [Arg4]GpTx-1(1-34) | — | 0.165 | 5 | 0.003 | — | — | 55 | 1667 | — |
| 39 | [Lys4]GpTx-1(1-34) | — | 0.327 | 10.6 | 0.006 | — | — | 55 | 1767 | — |
| 265 | [Gly5]GpTx-1(1-34) | — | 12.8 | >10 | 0.009 | — | — | 1422 | >1111 | — |
| 88 | [Ile5]GpTx-1(1-34) | — | 2.12 | >10 | 0.002 | — | — | 1060 | >5000 | — |
| 268 | [Met5]GpTx-1(1-34) | — | 0.978 | >10 | 0.002 | — | — | 489 | >5000 | — |
| 272 | [Val5]GpTx-1(1-34) | — | 4.41 | >10 | 0.018 | — | — | 245 | >556 | — |
| 267 | [Leu5]GpTx-1(1-34) | — | 0.778 | >10 | 0.007 | — | — | 111 | >1429 | — |
| 649 | [2-Abu5]GpTx-1(1-34) | — | >10 | >10 | 0.083 | — | — | >120 | >120 | — |
| 650 | [Nva5]GpTx-1(1-34) | — | 4.26 | >10 | 0.038 | — | — | 112 | >263 | — |
| 657 | [NMePhe5]GpTx-1(1-34) | — | 0.727 | >10 | 0.018 | — | — | 40 | >556 | — |
| 678 | [Tle5]GpTx-1(1-34) | — | 4.819 | >10 | 0.023 | — | — | 210 | >435 | — |
| 683 | [Cpg5]GpTx-1(1-34) | — | 1.87 | >10 | 0.005 | — | — | 374 | >2000 | — |
| 684 | [Chg5]GpTx-1(1-34) | — | 1.749 | >10 | 0.007 | — | — | 250 | >1429 | — |
| 688 | [NMeLeu5]GpTx-1(1-34) | — | 8.47 | >10 | 0.026 | — | — | 326 | >385 | — |
| 286 | [Tyr6]GpTx-1(1-34) | — | 3.79 | 10 | 0.069 | — | — | 55 | 145 | — |
| 283 | [Pro6]GpTx-1(1-34) | — | 4.11 | 10 | 0.042 | — | — | 98 | 238 | — |
| 294 | [2PAL6]GpTx-1(1-34) | — | 2.94 | 10 | 0.042 | — | — | 70 | 238 | — |
| 296 | [SDMA7]GpTx-1(1-34) | — | 0.606 | 14 | 0.006 | — | — | 101 | 2333 | — |
| 145 | [Glu7]GpTx-1(1-34) | — | >10 | >10 | 0.098 | — | — | >102 | >102 | — |
| 295 | [K(Me2)7]GpTx-1(1-34) | — | 2.21 | >10 | 0.02 | — | — | 111 | >500 | — |
| 298 | [K(Me2)8]GpTx-1(1-34) | — | 0.884 | >10 | 0.004 | — | — | 221 | >2500 | — |
| 297 | [SDMA8]GpTx-1(1-34) | — | 0.57 | >10 | 0.005 | — | — | 114 | >2000 | — |
| 118 | [Thr8]GpTx-1(1-34) | — | 0.888 | >10 | 0.009 | — | — | 99 | >1111 | — |
| 119 | [Asp10]GpTx-1(1-34) | — | 2.45 | >10 | 0.003 | — | — | 817 | >3333 | — |
| 146 | [Glu10]GpTx-1(1-34) | — | 1.3 | >10 | 0.002 | — | — | 650 | >5000 | — |
| 90 | [Asn10]GpTx-1(1-34) | — | 0.749 | >10 | 0.002 | — | — | 375 | >5000 | — |
| 147 | [Glu11]GpTx-1(1-34) | — | 1.67 | >10 | 0.002 | — | — | 835 | >5000 | — |
| 163 | [1-Nal13]GpTx-1(1-34) | — | 0.291 | 7.33 | 0.002 | — | — | 146 | 3665 | — |
| 28 | [Glu15]GpTx-1(1-34) | — | 2.72 | 10 | 0.02 | — | — | 136 | 500 | — |
| 125 | [2-Abu2,17]GpTx-1(1-34) | — | 0.947 | 10 | 0.021 | — | — | 45 | 476 | — |
| 316 | [2PAL18]GpTx-1(1-34) | — | 1.57 | 13.7 | 0.003 | — | — | 523 | 4567 | — |
| 116 | [Cit18]GpTx-1(1-34) | — | 0.833 | 10 | 0.002 | — | — | 417 | 5000 | — |
| 49 | [Lys18]GpTx-1(1-34) | — | 0.58 | 16.4 | 0.002 | — | — | 290 | 8200 | — |
| 314 | [K(Me2)18]GpTx-1(1-34) | — | 0.774 | 10 | 0.005 | — | — | 155 | 2000 | — |
| 315 | [SDMA18]GpTx-1(1-34) | — | 0.593 | 10 | 0.006 | — | — | 99 | 1667 | — |
| 50 | [Lys19]GpTx-1(1-34) | — | 0.22 | 9.1 | 0.003 | — | — | 73 | 3033 | — |
| 331 | [Tyr22]GpTx-1(1-34) | — | 2.03 | >10 | 0.018 | — | — | 113 | >556 | — |
| 8 | [Ala22]GpTx-1(1-34) | — | 0.429 | 6.2 | 0.006 | — | — | 72 | 1033 | — |
| 334 | [2PAL22]GpTx-1(1-34) | — | 1.86 | 16 | 0.007 | — | — | 266 | 2286 | — |
| 117 | [Cit25]GpTx-1(1-34) | — | 1.86 | >10 | 0.004 | — | — | 465 | >2500 | — |
| 335 | [K(Me2)25]GpTx-1(1-34) | — | 0.764 | 13.3 | 0.008 | — | — | 96 | 1663 | — |
| 9 | [Ala25]GpTx-1(1-34) | — | 2.24 | 10 | 0.012 | — | — | 187 | 833 | — |
| 151 | [Glu25]GpTx-1(1-34) | — | 5.53 | >10 | 0.028 | — | — | 198 | >357 | — |

TABLE 30-continued

Electrophysiology by PatchXpress ® patch clamp system

| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
|---|---|---|---|---|---|---|---|---|---|---|
| 337 | [His26]GpTx-1(1-34) | — | 0.246 | 4.95 | 0.003 | — | — | 82 | 1650 | — |
| 350 | [4CO2-F26]GpTx-1(1-34) | — | 6.18 | >10 | 0.065 | — | — | 95 | >154 | — |
| 153 | [Glu28]GpTx-1(1-34) | — | 10.7 | >10 | 0.026 | — | — | 412 | >385 | — |
| 750 | [Asp28]GpTx-1(1-34) | — | 12.9 | >10 | 0.015 | — | — | 860 | >667 | — |
| 763 | [Gln28]GpTx-1(1-34) | — | 4.61 | >10 | 0.004 | — | — | 1153 | >2500 | — |
| 355 | [K(Me2)28]GpTx-1(1-34) | — | 1.43 | 8.74 | 0.011 | — | — | 130 | 795 | — |
| 79 | [1-Nal29]GpTx-1(1-34) | — | 5.92 | >10 | 0.033 | — | — | 179 | >303 | — |
| 129 | [2-Nal29]GpTx-1(1-34) | — | 7.37 | >10 | 0.066 | — | — | 112 | >152 | — |
| 384 | [2PAL32]GpTx-1(1-34) | — | 4.96 | >10 | 0.035 | — | — | 142 | >286 | — |
| 403 | [4CO2-F33]GpTx-1(1-34) | — | 0.742 | >10 | 0.003 | — | — | 247 | >3333 | — |
| 402 | [2PAL33]GpTx-1(1-34) | — | 0.277 | 3.46 | 0.01 | — | — | 28 | 346 | — |
| 696 | [Ala5;Leu6]GpTx-1(1-34) | — | 11.246 | >10 | 0.03 | — | — | 375 | >333 | — |
| 721 | [Ala5;Nle6]GpTx-1(1-34) | — | 2.828 | >10 | 0.01 | — | — | 283 | >1000 | — |
| 699 | [Ala5;1'NMeW6]GpTx-1(1-34) | — | 4.5 | >10 | 0.051 | — | — | 88 | >196 | — |
| 437 | [Ala5;Glu29]GpTx-1(1-34) | — | >10 | >10 | >10 | — | — | >1 | >1 | — |
| 613 | [3Pal5;Phe6]GpTx-1(1-34) | — | 12.3 | >10 | 0.063 | — | — | 195 | >159 | — |
| 636 | [2-Abu5;Leu6]GpTx-1(1-34) | — | 3.211 | >10 | 0.022 | — | — | 146 | >455 | — |
| 635 | [Aib5;Leu6]GpTx-1(1-34) | — | 6.89 | >10 | 0.02 | — | — | 345 | >500 | — |
| 661 | [Leu5,6]GpTx-1(1-34) | — | 4.387 | >10 | 0.011 | — | — | 399 | >909 | — |
| 641 | [Met5;Leu6]GpTx-1(1-34) | — | 3.591 | >10 | 0.27 | — | — | 13 | >37 | — |
| 673 | [NMeLeu5;Leu6]GpTx-1(1-34) | — | 1.893 | >10 | 0.012 | — | — | 158 | >833 | — |
| 674 | [NMePhe5;Leu6]GpTx-1(1-34) | — | 1.232 | 11.26 | 0.012 | — | — | 103 | 938 | — |
| 672 | [NMeVal5;Leu6]GpTx-1(1-34) | — | 5.495 | >10 | 0.05 | — | — | 110 | >200 | — |
| 705 | [Nva5;Glu28]GpTx-1(1-34) | — | >10 | >10 | 0.056 | — | — | >179 | >179 | — |
| 637 | [Nva5;Leu6]GpTx-1(1-34) | — | 9.928 | >10 | 0.083 | — | — | 120 | >120 | — |
| 632 | [Sar5;Phe6]GpTx-1(1-34) | — | 2.4 | >10 | 0.025 | — | — | 96 | >400 | — |
| 617 | [Ser5;Phe6]GpTx-1(1-34) | — | 3.63 | >10 | 0.024 | — | — | 151 | >417 | — |
| 659 | [Tle5;Leu6]GpTx-1(1-34) | — | 5.862 | >10 | 0.017 | — | — | 345 | >588 | — |
| 644 | [Val5;Leu6]GpTx-1(1-34) | — | 6.666 | >10 | 0.2 | — | — | 33 | >50 | — |
| 692 | [Ala5;1'NMeW32]GpTx-1(1-34) | — | 2.81 | >10 | 0.018 | — | — | 156 | >556 | — |
| 694 | [Arg4;Met5]GpTx-1(1-34) | — | 1.127 | 13.222 | 0.029 | — | — | 39 | 456 | — |
| 620 | [DiMeO-F5;Phe6]GpTx-1(1-34) | — | 5.09 | >10 | 0.033 | — | — | 154 | >303 | — |
| 693 | [Met5;1'NMeW32]GpTx-1(1-34) | — | 1.43 | 14.799 | 0.007 | — | — | 204 | 2114 | — |
| 723 | [Ala5;Leu6;Glu10]GpTx-1(1-34) | — | 16.757 | >10 | 0.03 | — | — | 559 | >333 | — |
| 708 | [Nva5;Leu6;Glu28]GpTx-1(1-34) | — | >10 | >10 | 0.042 | — | — | >238 | >238 | — |
| 703 | [Ala5;Phe6;Glu12]GpTx-1(1-34) | — | 1.529 | >10 | 0.028 | — | — | 55 | >357 | — |
| 725 | [Ala5;Nle6;Glu12]GpTx-1(1-34) | — | 6.452 | >10 | 0.023 | — | — | 281 | >435 | — |
| 732 | [Ala5,25;Phe6]GpTx-1(1-34) | — | 7.788 | >10 | 0.086 | — | — | 91 | >116 | — |
| 809 | [Ala5;Phe6;Arg28]GpTx-1(1-34) | — | 3.29 | >10 | 0.012 | — | — | 274 | >833 | — |
| 810 | [Ala5;Leu6;Arg28]GpTx-1(1-34) | — | 6.89 | >10 | 0.009 | — | — | 766 | >1111 | — |

TABLE 30-continued

Electrophysiology by PatchXpress ® patch clamp system

| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
|---|---|---|---|---|---|---|---|---|---|---|
| 515 | [Phe6; Atz(amino-PEG10)13]GpTx-1(1-34) | — | 0.14 | N.D. | 0.003 | — | — | 47 | — | — |
| 516 | [Phe6;Atz(amino-PEG10)22]GpTx-1(1-34) | — | 0.422 | N.D. | 0.003 | — | — | 141 | — | — |
| 517 | [Phe6;Atz(amino-PEG10)33]GpTx-1(1-34) | — | 0.353 | N.D. | 0.027 | — | — | 13 | — | — |
| 526 | [Phe6;Atz(amino-PEG10)15]GpTx-1(1-34) | — | 0.179 | N.D. | 0.006 | — | — | 30 | — | — |
| 593 | [Phe6,Atz(20kDa PEG)28]GpTx-1(1-34) | — | 10 | >10 | 0.733 | — | — | 14 | >14 | — |
| 594 | [Phe6,Atz(20kDa PEG)22]GpTx-1(1-34) | — | 10 | >10 | 0.728 | — | — | 14 | >14 | — |
| 518 | [Atz(amino-PEG10)1;Ala5;Phe6]GpTx-1(1-34) | — | | N.D. | 0.264 | — | — | 0 | — | — |
| 519 | [Ala5;Phe6;Atz(amino-PEG10)12]GpTx-1(1-34) | — | 0.463 | N.D. | 0.039 | — | — | 12 | — | — |
| 520 | [Ala5;Phe6;Atz(amino-PEG10)13]GpTx-1(1-34) | — | | N.D. | 0.093 | — | — | 0 | — | — |
| 521 | [Ala5;Phe6;Atz(amino-PEG10)33]GpTx-1(1-34) | — | | N.D. | 0.296 | — | — | 0 | — | — |
| 522 | [Phe6;Atz(amino-PEG10)33;1-Nal34]GpTx-1(1-34) | — | 0.097 | N.D. | 0.003 | — | — | 32 | — | — |
| 523 | [Phe6;Leu26;Atz(amino-PEG10)33]GpTx-1(1-34) | — | 0.209 | N.D. | 0.02 | — | — | 10 | — | — |
| 524 | [Ala5;Phe6;Atz(amino-PEG10)15]GpTx-1(1-34) | — | 0.85 | N.D. | 0.02 | — | — | 43 | — | — |
| 525 | [Ala5;Phe6;Atz(amino-PEG10)22]GpTx-1(1-34) | — | | N.D. | 0.119 | — | — | 0 | — | — |
| 527 | [Phe6;Atz(amino-PEG10)12;1-Nal34]GpTx-1(1-34) | — | 0.108 | N.D. | 0.014 | — | — | 8 | — | — |
| 100 | Ala-GpTx-1(1-34) | — | 0.655 | 10 | 0.012 | — | — | 55 | 833 | — |
| 811 | Gly-Ser-[Ala5;Phe6;Arg28]GpTx-1(1-34) | — | 1.73 | >10 | 0.011 | — | — | 157 | >909 | — |
| 812 | Gly-Ser-[Ala5;Leu6;Arg28]GpTx-1(1-34) | — | 9.77 | >10 | 0.012 | — | — | 814 | >833 | — |
| 814 | [Ala5;Leu6;Arg28]GpTx-1(1-34)-Trp-FreeAcid | — | >10 | >10 | 0.05 | — | — | >200 | >200 | — |
| 817 | Ala5;Phe6;Arg28]GpTx-1(1-34)-Phe-FreeAcid | — | 7 | >10 | 0.116 | — | — | 60 | >86 | — |
| 819 | Gly-Ser-[Ala5;Phe6;Arg28]GpTx-1(1-34)-Phe-FreeAcid | — | >7 | >10 | 0.047 | — | — | >149 | >213 | — |
| 820 | Gly-Ser-[Ala5;Leu6;Arg28]GpTx-1(1-34)-Phe-FreeAcid | — | >10 | >10 | 0.056 | — | — | >179 | >179 | — |
| 414 | GpTx-1(1-34)-2PAL | — | 1.01 | >10 | 0.027 | — | — | 37 | >370 | — |
| 435 | [Ala5;Glu28]GpTx-1(1-34) | — | >10 | >10 | 0.614 | — | — | >16 | >16 | — |
| 761 | [Ala5;Guf28]GpTx-1(1-34) | — | 5.08 | >10 | 0.005 | — | — | 1016 | >2000 | — |
| 762 | [Ala5;Dab28]GpTx-1(1-34) | — | 13.7 | >10 | 0.013 | — | — | 1054 | >769 | — |

TABLE 30-continued

| Electrophysiology by PatchXpress ® patch clamp system | | | | | | | | | | |
|---|---|---|---|---|---|---|---|---|---|---|
| SEQ ID NO: | Designation | Nav1.3 Use IC50 (µM) | Nav1.4 Use IC50 (µM) | Nav1.5 Use IC50 (µM) | Nav1.7 Use IC50 (µM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
| 744 | [Ala5;hArg28]GpTx-1(1-34) | — | >10 | >10 | 0.014 | — | — | >714 | >714 | — |
| 749 | [Ala5;HCit28]GpTx-1(1-34) | — | >10 | >10 | 0.025 | — | — | >400 | >400 | — |
| 737 | [Ala5;His28]GpTx-1(1-34) | — | >10 | >10 | 0.026 | — | — | >385 | >385 | — |
| 748 | [Ala5;Cit28]GpTx-1(1-34) | — | >10 | >10 | 0.03 | — | — | >333 | >333 | — |
| 739 | [Ala5;Gln28]GpTx-1(1-34) | — | >10 | >10 | 0.037 | — | — | >270 | >270 | — |
| 743 | [Ala5;SDMA28]GpTx-1(1-34) | — | >10 | >10 | 0.041 | — | — | >244 | >244 | — |
| 738 | [Ala5;Ser28]GpTx-1(1-34) | — | >10 | >10 | 0.045 | — | — | >222 | >222 | — |
| 745 | [Ala5;R(Me)28]GpTx-1(1-34) | — | >10 | >10 | 0.051 | — | — | >196 | >196 | — |
| 746 | [Ala5;Orn28]GpTx-1(1-34) | — | >10 | >10 | 0.059 | — | — | >169 | >169 | — |
| 753 | [2-Abu5;Nle6]GpTx-1(1-34) | — | 0.94 | >10 | 0.001 | — | — | 940 | >10000 | — |
| 700 | [Ala5;Asp10]GpTx-1(1-34) | — | >10 | >10 | 0.05 | — | — | >200 | >200 | — |
| 704 | [Val5;Glu28]GpTx-1(1-34) | — | >10 | >10 | 0.029 | — | — | >345 | >345 | — |
| 709 | [Val5;Leu6;Glu28]GpTx-1(1-34) | — | >10 | >10 | 0.086 | — | — | >116 | >116 | — |
| 701 | [Ala5;Asp10;Glu12]GpTx-1(1-34) | — | >10 | >10 | 0.554 | — | — | >18 | >18 | — |
| 710 | [Val5;Asp10]GpTx-1(1-34) | — | >10 | >10 | 0.174 | — | — | >57 | >57 | — |
| 711 | [Val5;Glu12]GpTx-1(1-34) | — | 11.96 | >10 | 0.074 | — | — | 162 | >135 | — |
| 712 | [Val5;Asp10;Glu12]GpTx-1(1-34) | — | >10 | >10 | 0.116 | — | — | >86 | >86 | — |
| 713 | [Val5;Cit25]GpTx-1(1-34) | — | >10 | >10 | 0.028 | — | — | >357 | >357 | — |
| 702 | [Ala5;Phe6;Asp10]GpTx-1(1-34) | — | 6.08 | >10 | 0.04 | — | — | 152 | >250 | — |
| 722 | [Ala5;Nle6;Glu10]GpTx-1(1-34) | — | >10 | >10 | 0.096 | — | — | >104 | >104 | — |
| 724 | [Ala5;Phe6;Glu10]GpTx-1(1-34) | — | 11.07 | >10 | 0.079 | — | — | 140 | >127 | — |
| 726 | [Ala5;Leu6;Glu12]GpTx-1(1-34) | — | 12.3 | >10 | 0.021 | — | — | 586 | >476 | — |
| 727 | [Ala5;Nle6;Glu28]GpTx-1(1-34) | — | >10 | >10 | 0.08 | — | — | >125 | >125 | — |
| — | [Ala5,Phe6,Atz(2kDa EtO-PEG*-{[Ala5,Phe6,Atz13*,Leu26,Arg28]GpTx-1(1-34)})13,Leu26,Arg28]GpTx-1(1-34); *= Et (Homodimeric Conjugate 3) | — | 2.2 | 19.2 | 0.091 | — | — | 24 | 211 | — |
| 1029 | Biotin[long chain]-[2-Abu5,13;Leu6;Arg28]GpTx-1(1-34) | — | 27.3 | >10 | 0.011 | — | — | 2482 | >909 | — |
| 1030 | [Ala5;Phe6;Glu10;K(Biotin)13;Leu26;Arg28]GpTx-1(1-34) | — | 7.13 | >10 | 0.015 | — | — | 475 | >667 | — |
| — | Biotin-Ahx-[Ala5,Phe6,Atz(2kDa EtO-PEG*-{Biotin}-Ahx-[Ala5,Phe6,Atz13*,Leu26,Arg28]GpTx-1(1-34)})13,Leu26,Arg28]GpTx-1(1-34); * = Et | — | 3.43 | >10 | 0.091 | — | — | 38 | >110 | — |

TABLE 30-continued

| Electrophysiology by PatchXpress ® patch clamp system | | | | | | | | | | |
|---|---|---|---|---|---|---|---|---|---|---|
| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
| | (Homodimeric Conjugate 4) | | | | | | | | | |
| 1032 | DOTA-[Ala5]GpTx-1(1-34) | — | >10 | >10 | 0.152 | — | — | >66 | >66 | — |
| 1033 | [Ala5;Phe6;K(DOTA)13; Leu26;Arg28]GpTx-1(1-34) | — | 13.1 | >10 | 0.0275 | — | — | 476 | >364 | — |
| 30 | [Glu29]GpTx-1(1-34) | — | >10 | >10 | >10 | — | — | — | — | — |
| 22 | [Ala5]GpTx-1(1-34) | — | 10.426 | >10 | 0.034 | — | — | 307 | >294 | — |
| 22 | [Ala5]GpTx-1(1-34) | — | 10.392 | >10 | 0.03 | — | — | 346 | >333 | — |
| 153 | [Glu28]GpTx-1 | — | 18.1 | >10 | 0.0501 | — | — | 361 | >200 | — |
| 809 | [Ala5;Phe6;Arg28]GpTx-1(1-34) | — | 3.29 | >10 | 0.012 | — | — | 274 | >833 | — |
| 810 | [Ala5;Leu6;Arg28]GpTx-1(1-34) | — | 6.89 | >10 | 0.009 | — | — | 766 | >1111 | — |
| 1034 | [Ala5,Phe6,2-Abu13,Leu26,Arg28]GpTx-1(1-34) | — | 7.26 | >10 | 0.0047 | — | — | 1545 | >2128 | — |
| 1035 | [Ala5,Phe6,Glu10,2-Abu13,Leu26,Arg28]GpTx-1(1-34) | — | 16.6 | >10 | 0.0035 | — | — | 4743 | >2857 | — |
| 1036 | [Ala5,Leu6,2-Abu13,Leu26,Arg28]GpTx-1(1-34) | — | 18 | >10 | 0.0087 | — | — | 2069 | >1149 | — |
| 640 | [Ala5,Phe6,Pra13,Leu26, Arg28]GpTx-1(1-34) | — | 4.029 | >10 | 0.003 | — | — | 1343 | >3333 | — |
| 798 | [Ala5;Phe6;Glu10;Pra13; Leu26;Arg28]GpTx-1(1-34) | — | 10.4 | 15.3 | 0.012 | — | — | 867 | 1275 | — |
| 796 | [Ala5;Leu6,26;Pra13; Arg28]GpTx-1(1-34) | — | 10.6 | >10 | 0.009 | — | — | 1178 | >1111 | — |
| 800 | [Ala5;Leu6,26;Glu10; Pra13;Arg28]GpTx-1(1-34) | — | >10 | >10 | 0.013 | — | — | >769 | >769 | — |
| 799 | [2-Abu5;Leu6;K(Ac-Pra)13]GpTx-1(1-34) | — | 4.66 | >10 | 0.011 | — | — | 424 | >909 | — |
| 801 | [2-Abu5;Leu6;K(4-Pen)13;Arg28]GpTx-1(1-34) | — | 5.71 | >10 | 0.002 | — | — | 2855 | >5000 | — |
| 807 | 4-Pen-[2-Abu5,13;Leu6;Arg28]GpTx-1(1-34) | — | 7.55 | >10 | 0.003 | — | — | 2517 | >3333 | — |
| 756 | 4-Pen-[Ala5;Phe6;2-Abu13;Arg28]GpTx-1(1-34) | — | 3.34 | >10 | 0.004 | — | — | 835 | >2500 | — |
| 794 | [Ala5;Phe6;K(Ac-Pra)13]GpTx-1(1-34) | — | 1.46 | >10 | 0.011 | — | — | 133 | >909 | — |
| 1037 | [Ala5,Phe6,Atz(PEG11-((2-hydroxyethyl)thio)acetamide)13, Leu26,Arg28]GpTx-1 | — | 5.07 | >10 | 0.035 | — | — | 145 | >286 | — |
| 1038 | [Ala5,Phe6,Atz(PEG3-(2-hydroxyethyl)thioacetamide)13, Leu26,Arg28]GpTx-1(1-34) | — | 1.8 | >10 | 0.003 | — | — | 600 | >3333 | — |
| 1039 | [Ala5;Phe6;Glu10;Atz(PEG11-((2-hydroxyethyl)thio)acetamide)13; Leu26;Arg28]GpTx-1(1-34) | — | >10 | >10 | 0.021 | — | — | >476 | >476 | — |
| 1040 | [Ala5;Phe6;Glu10;Atz(PEG3-((2-hydroxyethyl)thio)acetamide)13; Leu26;Arg28]GpTx-1(1-34) | — | 5.95 | >10 | 0.013 | — | — | 458 | >769 | — |

TABLE 30-continued

| SEQ ID NO: | Designation | Nav1.3 Use IC50 (μM) | Nav1.4 Use IC50 (μM) | Nav1.5 Use IC50 (μM) | Nav1.7 Use IC50 (μM) | Nav1.4/ Nav1.3 Use | Nav1.5/ Nav1.3 Use | Nav1.4/ Nav1.7 Use | Nav1.5/ Nav1.7 Use | Nav1.3/ Nav1.7 Use |
|---|---|---|---|---|---|---|---|---|---|---|
| | Electrophysiology by PatchXpress ® patch clamp system | | | | | | | | | |
| 1041 | ((2-Hydroxyethyl)thio)acetamide-NPEG11-triazole-[2-Abu5,13;Leu6;Arg28]GpTx-1(1-34) | — | >10 | >10 | 0.087 | — | — | >115 | >115 | — |
| 1042 | [2-Abu5,Leu6,K(ethyl-triazole-PEG11-((2-hydroxyethyl)thio)acetamide)13, Arg28]GpTx-1(1-34) | — | 9.88 | >10 | 0.018 | — | — | 549 | >556 | — |
| 1043 | [Ala5;Leu6,26;Atz(PEG11-((2-hydroxyethyl)thio)acetamide)13; Arg28]GpTx-1(1-34) | — | >10 | >10 | 0.021 | — | — | >476 | >476 | — |
| 1044 | [Ala5;Leu6,26;Glu10; Atz(PEG11-((2-hydroxyethyl)thio)acetamide)13; Arg28]GpTx-1(1-34) | — | >10 | >10 | 0.054 | — | — | >185 | >185 | — |
| 1045 | ((2-hydroxyethyl)thio)acetamide-NPEG11-triazole-[Ala5,Phe6,2-Abu13,Arg28]GpTx-1(1-34) | — | 9.65 | >10 | 0.074 | — | — | 130 | >135 | — |
| — | Fc-peptide Conjugate 1 | — | 2.88 | >10 | 0.002 | — | — | 1440 | >5000 | — |
| — | Fc-peptide Conjugate 2 | — | 13.7 | >10 | 0.08 | — | — | 171 | >125 | — |
| — | Immunoglobulin-peptide Conjugate 1 | — | >10 | >10 | 0.565 | — | — | >18 | >18 | — |
| — | Immunoglobulin-peptide Conjugate 2 | — | 6.73 | >10 | 0.026 | — | — | 259 | >385 | — |
| — | Fc-peptide Conjugate 1 | — | >10 | >10 | 0.694 | — | — | 14 | >14 | — |
| — | Fc-peptide Conjugate 2 | — | 15.2 | >10 | 0.169 | — | — | 90 | >59 | — |
| — | Immunoglobulin-peptide Conjugate 1 | — | >10 | >10 | 0.716 | — | — | >14 | >14 | — |
| — | Immunoglobulin-peptide Conjugate 2 | — | 7.51 | >10 | 0.079 | — | — | 95 | >127 | — |
| — | Fc-peptide Conjugate 3 | — | >10 | >10 | 1.45 | — | — | >7 | >7 | — |
| — | Fc-peptide Conjugate 4 | — | >10 | >10 | 0.474 | — | — | >21 | >21 | — |
| — | Immunoglobulin-peptide Conjugate 3 | — | >10 | >10 | 0.077 | — | — | >130 | >130 | — |
| — | Immunoglobulin-peptide Conjugate 4 | — | >10 | >10 | 0.126 | — | — | >79 | >79 | — |
| — | Fc-peptide Conjugate 5 | — | >10 | >10 | 1.46 | — | — | >7 | >7 | — |
| — | Fc-peptide Conjugate 6 | — | >10 | >10 | 0.264 | — | — | >38 | >38 | — |
| — | Immunoglobulin-peptide Conjugate 5 | — | >10 | >10 | 0.927 | — | — | >11 | >11 | — |
| — | Immunoglobulin-peptide Conjugate 6 | — | >10 | >10 | 0.271 | — | — | >37 | >37 | — |
| — | Fc-peptide Conjugate 7 | — | N.D. | N.D. | 1.034 | — | — | — | — | — |
| — | Fc-peptide Conjugate 8 | — | >10 | >10 | 0.473 | — | — | >21 | >21 | — |
| — | Immunoglobulin-peptide Conjugate 7 | — | 7.87 | >10 | 0.456 | — | — | 17 | >22 | — |
| — | Immunoglobulin-peptide Conjugate 8 | — | 0.607 | 9.24 | 0.148 | — | — | 4 | 62 | — |

TABLE 31

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 532 | {H}-[Atz(amino-PEG10)]DCLGFFRKCIPDNDKCCRPNLVCSRTHKWCKYVF-{Amide} | Atz(amino-PEG10)-[Phe6]GpTx1(1-34) | 0.084 | 4.95 | 0.95 | 0.034 | 11.3 | 27.7 | 2.4 |
| 533 | {H}-[Atz(amino-PEG10)]CLGFFRKCIPDNDKCCRPNLVCSRTHKWCKYVF-{Amide} | [Atz(amino-PEG10)1;Phe6]GpTx1(1-34) | 0.041 | 6.91 | 0.25 | 0.019 | 6.1 | 12.9 | 2.1 |
| 534 | {H}-DCLG[Atz(amino-PEG10)]FRKCIPDNDKCCRPNLVCSRTHKWCKYVF-{Amide} | [Atz(amino-PEG10)5;Phe6]GpTx1(1-34) | 16.257 | 14.9 | 8.9 | 16.793 | 0.5 | 0.5 | 1.0 |
| 535 | {H}-DCLGF[Atz(amino-PEG10)]RKCIPDNDKCCRPNLVCSRTHKWCKYVF-{Amide} | [Atz(amino-PEG10)6]GpTx1(1-34) | 5.4 | 6.15 | 20.26 | 6.7 | 3.7 | 3.0 | 0.8 |
| 536 | {H}-DCLGFFRKC[Atz(amino-PEG10)]PDNDKCCRPNLVCSRTHKWCKYVF-{Amide} | [Phe6;Atz(amino-PEG10)10]GpTx1(1-34) | 0.039 | 7.95 | 0.32 | 0.013 | 8.3 | 24.6 | 3.0 |
| 537 | {H}-DCLGFFRKCI[Atz(amino-PEG10)]DNDKCCRPNLVCSRTHKWCKYVF-{Amide} | [Phe6;Atz(amino-PEG10)11]GpTx1(1-34) | 0.136 | 8.02 | 1.10 | 0.056 | 8.1 | 19.6 | 2.4 |
| 538 | {H}-DCLGFFRKCIP[Atz(amino-PEG10)]NDKCCRPNLVCSRTHKWCKYVF-{Amide} | [Phe6;Atz(amino-PEG10)12]GpTx1(1-34) | 0.050 | 6.31 | 0.16 | 0.016 | 3.2 | 9.8 | 3.1 |
| 515 | {H}-DCLGFFRKCIPD[Atz(amino-PEG10)]DKCCRPNLVCSRTHKWCKYVF-{Amide} | [Phe6;Atz(amino-PEG10)13]GpTx1(1-34) | 0.025 | 4.710 | 0.400 | 0.010 | 16.2 | 39.5 | 2.4 |
| 526 | {H}-DCLGFFRKCIPDND[Atz(amino-PEG10)]CCRPNLVCSRTHKWCKYVF-{Amide} | [Phe6;Atz(amino-PEG10)15]GpTx1(1-34) | 0.046 | >5 | 1.177 | 0.024 | 25.8 | 50.1 | 1.9 |
| 539 | {H}-DCLGFFRKCIPDNDKCCRP[Atz(amino-PEG10)]LVCSRTHKWCKYVF-{Amide} | [Phe6;Atz(amino-PEG10)20]GpTx1(1-34) | 0.538 | 8.9 | 5.6 | 0.250 | 10.4 | 22.4 | 2.1 |
| 540 | {H}-DCLGFFRKCIPDNDKCCRPN[Atz(amino-PEG10)]VCSRTHKWCKYVF-{Amide} | [Phe6;Atz(amino-PEG10)21]GpTx1(1-34) | 0.763 | 11.4 | 12.0 | 0.587 | 15.8 | 20.5 | 1.3 |
| 516 | {H}-DCLGFFRKCIPDNDKCCRPNL[Atz(amino-PEG10)]CSRTHKWCKYVF-{Amide} | [Phe6;Atz(amino-PEG10)22]GpTx1(1-34) | 0.111 | 7.9 | 1.1 | 0.059 | 10.1 | 19.1 | 1.9 |
| 541 | {H}-DCLGFFRKCIPDNDKCCRPNLVC[Atz(amino-PEG10)]RTHKWCKYVF-{Amide} | [Phe6;Atz(amino-PEG10)24]GpTx1(1-34) | 1.738 | 6.2 | 8.9 | 0.701 | 5.1 | 12.7 | 2.5 |

TABLE 31-continued

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 542 | {H}-DCLGFFRKCIPDNDKCCRPNLVCS[Atz(amino-PEG10)]THKWCKYVF-{Amide} | [Phe6;Atz(amino-PEG10)25]GpTx1(1-34) | 0.304 | 10.2 | 4.0 | 0.206 | 13.1 | 19.3 | 1.5 |
| 543 | {H}-DCLGFFRKCIPDNDKCCRPNLVCSR[Atz(amino-PEG10)]HKWCKYVF-{Amide} | [Phe6;Atz(amino-PEG10)26]GpTx1(1-34) | 0.631 | 8.0 | 9.4 | 0.478 | 14.9 | 19.6 | 1.3 |
| 544 | {H}-DCLGFFRKCIPDNDKCCRPNLVCSRTH[Atz(amino-PEG10)]KWCKYVF-{Amide} | [Phe6;Atz(amino-PEG10)27]GpTx1(1-34) | 2.6 | >5 | >5 | 3.7 | ##### | ####### | 0.7 |
| 545 | {H}-DCLGFFRKCIPDNDKCCRPNLVCSRTH[Atz(amino-PEG10)]WCKYVF-{Amide} | [Phe6;Atz(amino-PEG10)28]GpTx1(1-34) | 0.049 | 5.9 | 22.3 | 0.036 | 453.4 | 625.5 | 1.4 |
| 546 | {H}-DCLGFFRKCIPDNDKCCRPNLVCSRTHK[Atz(amino-PEG10)]CKYVF-{Amide} | [Phe6;Atz(amino-PEG10)29]GpTx1(1-34) | 0.31 | >5 | >5 | 1.1 | ##### | ####### | 0.3 |
| 547 | {H}-DCLGFFRKCIPDNDKCCRPNLVCSRTHKWCK[Atz(amino-PEG10)]VF-{Amide} | [Phe6;Atz(amino-PEG10)32]GpTx1(1-34) | 5.0 | >5 | >5 | >5 | ##### | ####### | ##### |
| 517 | {H}-DCLGFFRKCIPDNDKCCRPNLVCSRTHKWCKY[Atz(amino-PEG10)]F-{Amide} | [Phe6;Atz(amino-PEG10)33]GpTx1(1-34) | 0.10 | >5 | 1.1 | 0.032 | 10.3 | 33.5 | 3.3 |
| 548 | {H}-DCLGFFRKCIPDNDKCCRPNLVCSRTHKWCKYV[Atz(amino-PEG10)]-{Amide} | [Phe6;Atz(amino-PEG10)34]GpTx1(1-34) | 5.0 | >5 | >5 | 1.6 | ##### | ####### | 3.2 |
| 549 | {H}-DCLGFFRKCIPDNDKCCRPNLVCSRTHKWCKYVF[Atz(amino-PEG10)]-{Amide} | [Phe6]GpTx1(1-34)-Atz(amino-PEG10) | 0.36 | >5 | >5 | 0.12 | ##### | ####### | 3.0 |
| 550 | {H}-[Atz(amino-PEG10)]DCLGFFRKCIPDNDKCCRPNLVCSRTHKWCKYV[1-Nal]-{Amide} | Atz(amino-PEG10)-[Phe6;1-Nal34]GpTx1(1-34) | 0.029 | 6.80 | 0.15 | 0.004 | | | |
| 551 | {H}-[Atz(amino-PEG10)]CLGFFRKCIPDNDKCCRPNLVCSRTHKWCKYV[1-Nal]-{Amide} | [Atz(amino-PEG10)1;Phe6;1-Nal34]GpTx1(1-34) | 0.039 | 4.3 | 0.36 | 0.014 | 9.2 | 24.9 | 2.7 |
| 552 | {H}-DCLG[Atz(amino-PEG10)]FRKCIPDNDKCCRPNLVCSRTHKWCKYV[1-Nal]-{Amide} | [Atz(amino-PEG10)5;Phe6;1-Nal34]GpTx1(1-34) | 4.6 | >5 | >5 | 2.5 | ##### | ####### | 1.8 |

TABLE 31-continued

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 553 | {H}-DCLGF[Atz(amino-PEG10)]RKCIPDNDKCCRPNLVCSRTHKWCKYV[1-Nal]-{Amide} | [Atz(amino-PEG10)6;1-Nal34]GpTx1(1-34) | 4.1 | >5 | >5 | >5 | ##### | ####### | ##### |
| 554 | {H}-DCLGFFRKC[Atz(amino-PEG10)]PDNDKCCRPNLVCSRTHKWCKYV[1-Nal]-{Amide} | [Phe6;Atz(amino-PEG10)10;1-Nal34]GpTx1(1-34) | 0.058 | 8.61 | 0.14 | 0.015 | | | |
| 527 | {H}-DCLGFFRKCIP[Atz(amino-PEG10)]NDKCCRPNLVCSRTHKWCKYV[1-Nal]-{Amide} | [Phe6;Atz(amino-PEG10)12;1-Nal34]GpTx1(1-34) | 0.015 | 1.6 | 0.11 | 0.012 | 7.1 | 8.9 | 1.3 |
| 555 | {H}-DCLGFFRKCIPDNDKCCRPNLVC[Atz(amino-PEG10)]RTHKWCKYV[1-Nal]-{Amide} | [Phe6;Atz(amino-PEG10)24;1-Nal34]GpTx1(1-34) | 0.57 | >5 | >5 | 0.35 | ##### | ####### | 1.6 |
| 556 | {H}-DCLGFFRKCIPDNDKCCRPNLVCSR[Atz(amino-PEG10)]HKWCKYV[1-Nal]-{Amide} | [Phe6;Atz(amino-PEG10)26;1-Nal34]GpTx1(1-34) | 0.32 | >5 | >5 | 0.32 | ##### | ####### | 1.0 |
| 557 | {H}-DCLGFFRKCIPDNDKCCRPNLVCSRT[Atz(amino-PEG10)]KWCKYV[1-Nal]-{Amide} | [Phe6;Atz(amino-PEG10)27;1-Nal34]GpTx1(1-34) | 0.90 | >5 | >5 | 0.82 | ##### | ####### | 1.1 |
| 558 | {H}-DCLGFFRKCIPDNDKCCRPNLVCSRTHK[Atz(amino-PEG10)]CKYV[1-Nal]-{Amide} | [Phe6;Atz(amino-PEG10)29;1-Nal34]GpTx1(1-34) | 0.093 | >5 | >5 | 0.14 | ##### | ####### | 0.7 |
| 559 | {H}-DCLGFFRKCIPDNDKCCRPNLVCSRTHKWCK[Atz(amino-PEG10)]V[1-Nal]-{Amide} | [Phe6;Atz(amino-PEG10)32;1-Nal34]GpTx1(1-34) | 5.0 | >5 | >5 | 2.2 | ##### | ####### | 2.3 |
| 522 | {H}-DCLGFFRKCIPDNDKCCRPNLVCSRTHKWCKY[Atz(amino-PEG10)][1-Nal]-{Amide} | [Phe6;Atz(amino-PEG10)33;1-Nal34]GpTx1(1-34) | 0.032 | >5 | 0.39 | 0.014 | 12.0 | 27.3 | 2.3 |
| 560 | {H}-DCLGFFRKCIPDNDKCCRPNLVCSRTHKWCKYV[1-Nal][Atz(amino-PEG10)]-{Amide} | [Phe6;1-Nal34]GpTx1(1-34)-Atz(amino-PEG10) | 0.12 | >5 | 2.2 | 0.037 | 18.3 | 58.3 | 3.2 |
| 561 | {H}-DCLGFFRKCIPDNDKCCRPNLVCSRTHKWCKYV[1-Nal]-{Amide} | [Phe6;1-Nal34]GpTx1(1-34) | 0.011 | 2.2 | 0.17 | 0.007 | 14.7 | 23.5 | 1.6 |

TABLE 31-continued

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 562 | {H}-[Atz(amino-PEG10)]DCLGAFRKCIPDNDKCCRPNLVCSRTHKWCKYVF-{Amide} | Atz(amino-PEG10)-[Ala5;Phe6]GpTx1(1-34) | 0.24 | >5 | 2.8 | 0.14 | 11.9 | 20.7 | 1.7 |
| 518 | {H}-[Atz(amino-PEG10)]CLGAFRKCIPDNDKCCRPNLVCSRTHKWCKYVF-{Amide} | [Atz(amino-PEG10)1;Ala5;Phe6]GpTx1(1-34) | 0.36 | >5 | >5 | 0.14 | ##### | ####### | 2.5 |
| 563 | {H}-DC[Atz(amino-PEG10)]GAFRKCIPDNDKCCRPNLVCSRTHKWCKYVF-{Amide} | [Atz(amino-PEG10)3;Ala5;Phe6]GpTx1(1-34) | 0.20 | >5 | >5 | 0.072 | ##### | ####### | 2.7 |
| 564 | {H}-DCL[Atz(amino-PEG10)]AFRKCIPDNDKCCRPNLVCSRTHKWCKYVF-{Amide} | [Atz(amino-PEG10)4;Ala5;Phe6]GpTx1(1-34) | 2.8 | >5 | >5 | 1.4 | ##### | ####### | 2.0 |
| 565 | {H}-DCLGA[Atz(amino-PEG10)]RKCIPDNDKCCRPNLVCSRTHKWCKYVF-{Amide} | [Ala5;Atz(amino-PEG10)6]GpTx1(1-34) | 5.0 | >5 | >5 | >5 | ##### | ####### | ##### |
| 566 | {H}-DCLGAF[Atz(amino-PEG10)]KCIPDNDKCCRPNLVCSRTHKWCKYVF-{Amide} | [Ala5;Phe6;Atz(amino-PEG10)7]GpTx1(1-34) | 5.0 | >5 | >5 | >5 | ##### | ####### | ##### |
| 567 | {H}-DCLGAFR[Atz(amino-PEG10)]CIPDNDKCCRPNLVCSRTHKWCKYVF-{Amide} | [Ala5;Phe6;Atz(amino-PEG10)8]GpTx1(1-34) | 2.3 | >5 | >5 | 1.4 | ##### | ####### | 1.6 |
| 568 | {H}-DCLGAFRKC[Atz(amino-PEG10)]PDNDKCCRPNLVCSRTHKWCKYVF-{Amide} | [Ala5;Phe6;Atz(amino-PEG10)10]GpTx1(1-34) | 0.26 | >5 | >5 | 0.076 | ##### | ####### | 3.5 |
| 519 | {H}-DCLGAFRKCIP[Atz(amino-PEG10)]NDKCCRPNLVCSRTHKWCKYVF-{Amide} | [Ala5;Phe6;Atz(amino-PEG10)12]GpTx1(1-34) | 0.17 | >5 | 1.5 | 0.088 | 8.7 | 16.8 | 1.9 |
| 520 | {H}-DCLGAFRKCIPD[Atz(amino-PEG10)]DKCCRPNLVCSRTHKWCKYVF-{Amide} | [Ala5;Phe6;Atz(amino-PEG10)13]GpTx1(1-34) | 0.27 | >5 | >5 | 0.11 | ##### | ####### | 2.5 |
| 524 | {H}-DCLGAFRKCIPDND[Atz(amino-PEG10)]CCRPNLVCSRTHKWCKYVF-{Amide} | [Ala5;Phe6;Atz(amino-PEG10)15]GpTx1(1-34) | 0.21 | >5 | 3.7 | 0.089 | 17.5 | 41.2 | 2.3 |
| 569 | {H}-DCLGAFRKCIPDNDKCC[Atz(amino-PEG10)]PNLVCSRTHKWCKYVF-{Amide} | [Ala5;Phe6;Atz(amino-PEG10)18]GpTx1(1-34) | 0.23 | >5 | >5 | 0.11 | ##### | ####### | 2.2 |

TABLE 31-continued

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (μM) | IWQ Use Nav1.5 (μM) | IWQ Use Nav1.4 (μM) | IWQ Use Nav1.3 (μM) | Nav1.4/Nav1.7 | Nav1.4/Nav1.3 | Nav1.7/Nav1.3 |
|---|---|---|---|---|---|---|---|---|---|
| 570 | {H}-DCLGAFRKCIPDNDKCCR[Atz(amino-PEG10)]NLVCSRTHKWCKYVF-{Amide} | [Ala5;Phe6;Atz(amino-PEG10)19]GpTx1(1-34) | 0.64 | >5 | >5 | 0.52 | ##### | ####### | 1.2 |
| 571 | {H}-DCLGAFRKCIPDNDKCCRP[Atz(amino-PEG10)]LVCSRTHKWCKYVF-{Amide} | [Ala5;Phe6;Atz(amino-PEG10)20]GpTx1(1-34) | 5.0 | >5 | >5 | 4.0 | ##### | ####### | 1.3 |
| 572 | {H}-DCLGAFRKCIPDNDKCCRPN[Atz(amino-PEG10)]VCSRTHKWCKYVF-{Amide} | [Ala5;Phe6;Atz(amino-PEG10)21]GpTx1(1-34) | 5.0 | >5 | >5 | 1.8 | ##### | ####### | 2.8 |
| 525 | {H}-DCLGAFRKCIPDNDKCCRPNL[Atz(amino-PEG10)]CSRTHKWCKYVF-{Amide} | [Ala5;Phe6;Atz(amino-PEG10)22]GpTx1(1-34) | 0.66 | >5 | >5 | 0.23 | ##### | ####### | 2.9 |
| 573 | {H}-DCLGAFRKCIPDNDKCCRPNLVC[Atz(amino-PEG10)]RTHKWCKYVF-{Amide} | [Ala5;Phe6;Atz(amino-PEG10)24]GpTx1(1-34) | 5.0 | >5 | >5 | >5 | ##### | ####### | ##### |
| 574 | {H}-DCLGAFRKCIPDNDKCCRPNLVCS[Atz(amino-PEG10)]THKWCKYVF-{Amide} | [Ala5;Phe6;Atz(amino-PEG10)25]GpTx1(1-34) | 0.90 | >5 | >5 | 1.6 | ##### | ####### | 0.6 |
| 575 | {H}-DCLGAFRKCIPDNDKCCRPNLVCSRT[Atz(amino-PEG10)]KWCKYVF-{Amide} | [Ala5;Phe6;Atz(amino-PEG10)27]GpTx1(1-34) | 5.0 | >5 | >5 | >5 | ##### | ####### | ##### |
| 576 | {H}-DCLGAFRKCIPDNDKCCRPNLVCSRTH[Atz(amino-PEG10)]WCKYVF-{Amide} | [Ala5;Phe6;Atz(amino-PEG10)28]GpTx1(1-34) | 1.7 | >5 | >5 | 1.7 | ##### | ####### | 1.0 |
| 577 | {H}-DCLGAFRKCIPDNDKCCRPNLVCSRTHK[Atz(amino-PEG10)]CKYVF-{Amide} | [Ala5;Phe6;Atz(amino-PEG10)29]GpTx1(1-34) | 5.0 | >5 | >5 | >5 | ##### | ####### | ##### |
| 578 | {H}-DCLGAFRKCIPDNDKCCRPNLVCSRTHKWCK[Atz(amino-PEG10)]VF-{Amide} | [Ala5;Phe6;Atz(amino-PEG10)32]GpTx1(1-34) | 5.0 | >5 | >5 | >5 | ##### | ####### | ##### |
| 521 | {H}-DCLGAFRKCIPDNDKCCRPNLVCSRTHKWCKY[Atz(amino-PEG10)]F-{Amide} | [Ala5;Phe6;Atz(amino-PEG10)33]GpTx1(1-34) | 1.5 | >5 | >5 | 0.41 | ##### | ####### | 3.7 |
| 579 | {H}-DCLGAFRKCIPDNDKCCRPNLVCSRTHKWCKYVF[Atz(amino-PEG10)]-{Amide} | [Ala5;Phe6]GpTx1(1-34)-Atz(amino-PEG10) | 5.0 | >5 | >5 | >5 | ##### | ####### | ##### |
| 580 | {H}-DCLGAFRKCIPDNDKCCRPNLVCSRTHKWCKYVFW[Atz(amino-PEG10)]-{Amide} | [Ala5;Phe6]GpTx1(1-34)-Trp-Atz(amino-PEG10) | 1.2 | >5 | >5 | 0.77 | ##### | ####### | 1.6 |

TABLE 31-continued

Electrophysiology by IonWorks ® Quattro patch clamp system: comparison of GpTx-1 peptide analog PEG conjugates.

| SEQ ID NO: | Amino acid sequence | Designation | IWQ Use Nav1.7 (µM) | IWQ Use Nav1.5 (µM) | IWQ Use Nav1.4 (µM) | IWQ Use Nav1.3 (µM) | Nav1.4/Nav1.7 | Nav1.4/Nav1.3 | Nav1.7/Nav1.3 |
|---|---|---|---|---|---|---|---|---|---|
| 581 | {H}-[Atz(amino-PEG10)]CLGFFRKCIPDNDKCCRPNLVCSRLHKWCKYVF-{Amide} | [Atz(amino-PEG10)1;Phe6;Leu26]GpTx1(1-34) | 0.025 | 6.22 | 0.29 | 0.018 | | | |
| 582 | {H}-DCLG[Atz(amino-PEG10)]FRKCIPDNDKCCRPNLVCSRLHKWCKYVF-{Amide} | [Atz(amino-PEG10)5;Phe6;Leu26]GpTx1(1-34) | 7.9 | 8.08 | 17.21 | 4.0 | | | |
| 583 | {H}-DCLGF[Atz(amino-PEG10)]RKCIPDNDKCCRPNLVCSRLHKWCKYVF-{Amide} | [Atz(amino-PEG10)6;Leu26]GpTx1(1-34) | 7.4 | 8.36 | 20.91 | 5.8 | | | |
| 523 | {H}-DCLGFFRKC[Atz(amino-PEG10)]PDNDKCCRPNLVCSRLHKWCKYVF-{Amide} | [Phe6;Atz(amino-PEG10)10;Leu26]GpTx1(1-34) | 0.027 | 7.19 | 0.50 | 0.014 | | | |
| 584 | {H}-DCLGFFRKCIPDNDKCCRPNLVCSRLHK[Atz(amino-PEG10)]CKYVF-{Amide} | [Phe6;Leu26;Atz(amino-PEG10)29]GpTx1(1-34) | 0.76 | >5 | >5 | 1.6 | ##### | ####### | 0.5 |
| 585 | {H}-DCLGFFRKCIPDNDKCCRPNLVCSRLHKWCK[Atz(amino-PEG10)]VF-{Amide} | [Phe6;Leu26;Atz(amino-PEG10)32]GpTx1(1-34) | 5.0 | >5 | >5 | >5 | ##### | ####### | ##### |
| 586 | {H}-DCLGFFRKCIPDNDKCCRPNLVCSRLHKWCKY[Atz(amino-PEG10)]F-{Amide} | [Phe6;Leu26;Atz(amino-PEG10)33]GpTx1(1-34) | 0.055 | >5 | 1.8 | 0.026 | 33.1 | 69.6 | 2.1 |
| 587 | {H}-DCLGFFRKCIPDNDKCCRPNLVCSRLHKWCKYV[Atz(amino-PEG10)]-{Amide} | [Phe6;Leu26;Atz(amino-PEG10)34]GpTx1(1-34) | 1.4 | >5 | >5 | 1.1 | ##### | ####### | 1.2 |
| 588 | {H}-DCLGFFRKCIPDNDKCCRPNLVCSRLHKWCKYVF[Atz(amino-PEG10)]-{Amide} | [Phe6;Leu26]GpTx1(1-34)-Atz(amino-PEG10) | 0.43 | >5 | >5 | 0.13 | ##### | ####### | 3.3 |

TABLE 32

| Nav1.7 Use IC50 of conjugated GpTx-1 peptide analogs by PatchXpress ® patch clamp system. | | |
|---|---|---|
| SEQ ID NO: | Designation | Nav1.7 Use IC50 (μM) |
| 1 | GpTx-1(1-34) | 0.005 |
| 515 | [Phe6; Atz(amino-PEG10)13]GpTx1(1-34) | 0.022 |
| 515 | [Phe6; Atz(amino-PEG10)13]GpTx1(1-34) | 0.003 |
| 516 | [Phe6; Atz(amino-PEG10)22]GpTx1(1-34) | 0.003 |
| 517 | [Phe6; Atz(amino-PEG10)33]GpTx1(1-34) | 0.027 |
| 518 | [Atz(amino-PEG10)1; Ala5; Phe6]GpTx1(1-34) | 0.264 |
| 519 | [Ala5; Phe6; Atz(amino-PEG10)12]GpTx1(1-34) | 0.039 |
| 520 | [Ala5; Phe6; Atz(amino-PEG10)13]GpTx1(1-34) | 0.093 |
| 521 | [Ala5; Phe6; Atz(amino-PEG10)33]GpTx1(1-34) | 0.296 |
| 522 | [Phe6; Atz(amino-PEG10)33; 1-Nal34]GpTx1(1-34) | 0.003 |
| 523 | [Phe6; Leu26; Atz(amino-PEG10)33]GpTx1(1-34) | 0.020 |
| 524 | [Ala5; Phe6; Atz(amino-PEG10)15]GpTx1(1-34) | 0.020 |
| 525 | [Ala5; Phe6; Atz(amino-PEG10)22]GpTx1(1-34) | 0.119 |
| 526 | [Phe6; Atz(amino-PEG10)15]GpTx1(1-34) | 0.006 |
| 527 | [Phe6; Atz(amino-PEG10)12; 1-Nal34]GpTx1(1-34) | 0.014 |

Example 4

Plasma Stability Studies

The stability of GpTx-1 peptide and GpTx-1 peptide analogs were studied in human, rat and mouse plasmas. Peptide stock solutions were made from GpTx-1 peptide and GpTx-1 peptide analog reference standards in 50/50 (v/v) methanol/water and stored at −20° C. 1 mg/mL peptide stock solutions were used to prepare 20 μg/mL peptide working solutions in HPLC grade water. The peptide working solutions were stored in a refrigerator at 2 to 8° C. prior to use.

Stability samples were prepared by adding 225 μl plasma into the vials containing 25 μl of 20 μg/mL peptide working solutions and were incubated at 37° C. The initial concentration was 2 μg/mL for each peptide in human, rat, or mouse plasma. 25 μl plasma samples at five time points (0, 2, 4, 8 and 24 hours) were aliquoted into the appropriate well of a 96-well plate, followed by the addition of 25 μl of internal standard solution (100 ng/mL, NAV peptide analog made in 50/50 methanol/water) and 100 μL of 0.1% formic acid and the samples were vortex mixed. An Oasis HLB μElution 96-well solid phase extraction plate was used to extract GpTx-1 or GpTx-peptide analog peptides from the pretreated plasma samples and the extracts were injected (10 μL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH $C_{18}$ 2.1 mm×50 mm column. The mobile phases were 0.1% formic acid in acetonitrile/water (5/95, v/v, mobile phase A) and 0.1% formic acid in acetonitrile/water (95/5, v/v, mobile phase B). Data was collected and processed using AB Sciex Analyst® software (version 1.5).

The plasma stability of the tested peptides were derived from the peak area ratios corresponding to peptides and internal standard obtained from the LC-MS/MS analysis, all data were normalized to the value at 0-hr time point. Results are shown in Table 33, Table 34, and Table 35, below. GpTx-1 and GpTx-1 peptide analogs tested showed remarkable stability in human, mouse, and rat plasma, likely due to their compact, disulfide-stabilized structure.

TABLE 33

| Stability of GpTx-1 and GpTx-1 peptide analogs in human plasma. | | | | | |
|---|---|---|---|---|---|
| | % peptide remaining | | | | |
| incubation time (hr) | GpTx-1(1-34); SEQ ID NO: 1 | [1-Nal10]GpTx-1(1-34); SEQ ID NO: 78 | [Ala5]GpTx-1(1-34); SEQ ID NO: 22 | GpTx-1(2-34); SEQ ID NO: 108 | Ac-GpTx-1(1-34); SEQ ID NO: 132 |
| 0 | 100 | 100 | 100 | 100 | 100 |
| 2 | 102 | 99 | 105 | 107 | 100 |
| 4 | 101 | 93 | 99 | 92 | 104 |
| 8 | 98 | 97 | 101 | 91 | 101 |
| 24 | 93 | 82 | 105 | 82 | 97 |

TABLE 34

| Stability of GpTx-1 and GpTx-1 peptide analogs in mouse plasma. | | | | | |
|---|---|---|---|---|---|
| | % peptide remaining | | | | |
| incubation time (hr) | GpTx-1(1-34); SEQ ID NO: 1 | [1-Nal10]GpTx-1(1-34); SEQ ID NO: 78 | [Ala5]GpTx-1(1-34); SEQ ID NO: 22 | GpTx-1(2-34); SEQ ID NO: 108 | Ac-GpTx-1(1-34); SEQ ID NO: 132 |
| 0 | 100 | 100 | 100 | 100 | 100 |
| 2 | 103 | 98 | 106 | 100 | 105 |
| 4 | 105 | 92 | 107 | 95 | 103 |
| 8 | 97 | 92 | 105 | 87 | 103 |
| 24 | 93 | 88 | 99 | 81 | 106 |

TABLE 35

| Stability of GpTx-1 and GpTx-1 peptide analogs in rat plasma. | | |
|---|---|---|
| | % peptide remaining | |
| incubation time (hr) | GpTx-1(1-34); SEQ ID NO: 1 | [1-Nal10]GpTx-1(1-34); SEQ ID NO: 78 |
| 0 | 100 | 100 |
| 2 | 110 | 104 |
| 4 | 109 | 106 |
| 6 | 100 | 108 |
| 8 | 111 | 112 |
| 24 | 91 | 89 |

Example 5

PEGylated Conjugates of GpTx-1 Peptide Analogs Studies

To identify sites with GpTx-1 that could be modified with a half-life extending moiety, a set of positional analogs was prepared containing propargylglycine at each non-cysteine position. After folding, the alkyne-containing peptide was subjected to copper catalyzed 1,3-dipolar cycloaddition with a ~500 Da MW azido PEG to obtain the site-specifically PEGylated peptides with a triazole linkage, thus converting the propargylglycine or Pra residue in the sequence to a 3-(1,2,3-triazol-4-yl)alanine or Atz residue. Electrophysiological screening of this series of analogs (Table 30, Table 31, and Table 32, above) identified several positions within GpTx-1, including the N-terminus and positions 1, 10, 12, 13, 15, 22, 28, and 33 of SEQ ID NO:1, where a large chemical moiety could be introduced without significantly reducing potency at $Na_V1.7$ or $Na_V1.3$. In general, these locations tend to be on the hydrophilic surface of GpTx-1, away from or around the periphery the hydrophobic binding face. Having identified these positions, larger MW conjugates (20 kDa PEG; SEQ ID NO:590) and homodimeric constructs of [Phe6; Atz13]GpTx-1(1-34) (SEQ ID NO:591) or [Ala5; Phe6;Atz13]GpTx-1(1-34) (SEQ ID NO:1028) or Biotin-Ahx--[Ala5,Phe6,Atz13,Leu26,Arg28]GpTx-1(1-34) (SEQ ID NO:1031) were prepared (See, FIG. 81A) and tested (See, Table 30, and FIGS. 46-58). Four of these homodimers, with different sized PEG linkers covalently linked to each of the two peptides at position 13 relative to the native GpTx-1 sequence (SEQ ID NO:1), were designated as follows (*=ethyl):

[Phe6,Atz(2 kDa EtO-PEG*-{[Phe6,Atz13*]GpTx-1(1-34)}) 13]GpTx-1(1-34) ("Homodimeric Conjugate 1") (See, FIG. 81A);

[Phe6,Atz(500 Da EtO-PEG*-{[Phe6,Atz13*]GpTx-1(1-34)})13]GpTx-1(1-34) ("Homodimeric Conjugate 2");

[Ala5,Phe6,Atz(2 kDa EtO-PEG*-{[Ala5,Phe6,Atz13*, Leu26,Arg28]GpTx-1(1-34)})13,Leu26,Arg28]GpTx-1(1-34) ("Homodimeric Conjugate 3");

Biotin-Ahx-[Ala5,Phe6,Atz(2 kDa EtO-PEG*-{Biotin-Ahx-[Ala5,Phe6,Atz13*,Leu26,Arg28]GpTx-1(1-34)})13, Leu26,Arg28]GpTx-1(1-34) ("Homodimeric Conjugate 4").

Example 6

NMR Structure Determination of GpTx-1

The structure of GpTx-1 was obtained by high resolution NMR spectroscopy in water, pH ~3 and T=298 K. The data were collected on a Bruker Avance III 800 MHz spectrometer using standard 2D experiments. (See Wutchrich, NMR of Proteins and Nucleic Acids, John Wiley & Sons, Canada, (1986)). The structure was calculated from 500 NOE constraints (216 long-range), 45 dihedral angles constraints, 11 hydrogen-bond constraints and 3 disulfide-bond constraints, using Cyana 2.1 software. The final RMSD for the backbone atoms was 0.1±0.05 A and for all heavy atoms 0.74±0.12 A. (See FIG. 7 for the overlay of the 20 lowest energy conformations of the peptide backbone, FIG. 8 for the overlay of the heavy atoms from the 20 lowest energy conformations of the peptide, and FIG. 9 for a ribbon representation of the peptide backbone). The structure confirms the disulfide connectivity of the six cysteine residues as $C_2$-$C_{17}$, $C_9$-$C_{23}$, and $C_{16}$-$C_{30}$ or a C1-C4, C2-C5, C3-C6 pattern, making GpTx-1 a member of the inhibitory cystine knot (ICK) family of peptides.

The folded structure of GpTx-1 (SEQ ID NO:1) is amphipathic in nature with a flat hydrophobic face on one side of the molecule and a hydrophilic (mostly cationic) face on the opposite side. The systematic analoging of GpTx-1, in particular the positional scanning with alanine and glutamic acid, identifies several residues as being critical for activity at $Na_V1.7$ and $Na_V1.3$. These residues, namely Phe5, Met6, His27, Trp29, Lys31, Tyr32, and Phe34, relative to SEQ ID NO:1, are clustered on the one face of GpTx-1. Residues 27 through 34 of SEQ ID NO:1 form a C-terminal β-strand, while Phe5 and Met6 are adjacent to that strand and form the remainder of this hydrophobic face. Since changes that alter the nature of this face disrupt activity against $Na_V1.7$ and $Na_V1.3$, this may be the portion of the molecule that interacts with the VGSCs at the binding interface. (See FIG. 10 and FIG. 11).

Example 7

Preliminary Pharmacokinetic Determination in Mice

Pharmacokinetic Studies.

Preliminary pharmacokinetic (PK) studies were conducted. One PK study was conducted with 7 week-old male CD-1 mice from Charles River Laboratories. The mice had catheters placed in the carotid artery by the vendor. [Ala5] GpTx-1 (SEQ ID NO:22) was dosed intravenously to 3 mice and subcutaneously to 3 mice. GpTx-1 (SEQ ID NO:1) was dosed subcutaneously to 3 mice. All doses were at 1 mg/kg and i.v. injections were made via the lateral tail vein. Blood samples for i.v.-dosed animals were taken at 3, 15, 30 min and 1, 2, 4, 6, 8, and 24 hours post dose, blood samples for s.c.-dose animals were taken at 15, 30 min and 1, 2, 4, 6, 8, and 24 hours post dose. For each sample 15 μL of blood was collected via the carotid artery catheter and mixed in 35 μL of 0.1 M citrate buffer. Samples were then frozen at −80° C. until analysis.

Another PK study was conducted with 7 week-old unmodified male CD-1 mice from Taconic. [Ala5]GpTx-1 (SEQ ID NO:22) was dosed to 12 mice at 1 mg/kg subcutaneously and to 12 mice at 1 mg/kg intravenously via the lateral tail vein. At 0.5, 1, 2, 4, 8 and 24 hours post-dose, 2 mice from each dose route were euthanized and blood samples and brains were collected. Brains were weighed and frozen at −80° C. immediately. Blood samples were collected in EDTA-treated microtainers and centrifuged at 13000 rpm for 5 minutes, after which plasma was extracted and frozen at −80° C. in a 96-well plate.

Another PK study was conducted with 7 week-old unmodified CD-1 mice from Taconic. [Ala5]GpTx-1 (SEQ ID NO:22) was dosed to 21 mice at 5 mg/kg subcutaneously. At 0.5, 1, 1.25, 1.5, 2, 3, and 4 hours post-dose, 3 mice were euthanized and blood samples and brains were collected. Brains were weighed and frozen at −80° C. immediately. Blood samples were collected in EDTA-treated microtainers and centrifuged at 13000 rpm for 5 minutes, after which plasma was extracted and frozen at −80° C. in a 96-well plate.

LC-MS/MS Analytical Procedure.

Peptide stock solutions (1 mg/mL) were made from peptide reference standards in 50/50 (v/v) methanol/water and stored at −20° C. 1 mg/mL peptide stock solutions were used to prepare 100 μg/mL peptide working solution in 50/50 (v/v) methanol/water. The peptide working solutions were stored in a refrigerator at 2 to 8° C.

Standard samples were prepared in citrate-buffered mouse blood (blood/0.1M citrate buffer, 30/70, v/v). Standards concentrations of 5, 10, 25, 50, 100, 250, 500 and 1000 ng/mL were prepared by serial dilution of a freshly prepared 5000 ng/mL solution in citrate-buffered mouse blood using the 100 μg/mL peptide working solution. 25 μl blood samples were aliquoted into the appropriate well of a 96-well plate, followed by the addition of 50 μl of internal standard solution (100 ng/mL, peptide analog made in 50/50 methanol/water) and 150 μL of 0.1M $ZnSO_4$ and the samples were vortex mixed for 5 min, then centrifuge for 10 min at 4000 rpm. Supernatant was then extracted using an Oasis HLB μElution 96-well solid phase extraction plate to extract peptides and the extracts were injected (10 μL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH $C_{18}$ 2.1 mm×50 mm column. The mobile phases were 0.1% formic acid in acetonitrile/water (5/95, v/v, mobile phase A) and 0.1% formic acid in acetonitrile/water (95/5, v/v, mobile phase B). Data was collected and processed using AB Sciex Analyst® software (version 1.5).

The calibration curve was derived from the peak area ratios (peptide/internal standard) using $1/x^2$ weighted linear least-squares regression of the area ratio versus the concentration of the corresponding peptide standard. The regression equation from the calibration standards was used to back calculate the measured concentration for each standard and blood samples.

Results.

In the pharmacokinetic studies, GpTx-1 (SEQ ID NO:1) was found to be lethal to the mice at 1 mg/kg and 0.5 mg/kg i.v. doses. A 1 mg/kg s.c. dose of GpTx-1 (SEQ ID NO:1) to mice was tolerated and showed measureable plasma concentrations for 1 h. (See, FIG. 16). A 1 mg/kg i.v. dose of [Ala5]GpTx-1 (SEQ ID NO:22) was tolerated in mice with an approximate in vivo half-life of 15 min. (See, FIG. 17A and FIG. 17B). A 1 mg/kg s.c. dose of [Ala5]GpTx-1 (SEQ ID NO:22) also gave measurable exposure in blood. (See, FIG. 17B). In another study, a 5 mg/kg s.c. dose yielded peptide concentrations in the plasma that were sustained at about 0.6 μM, 40-fold over the in vitro Nav1.7 $IC_{50}$ as measured by PatchXpress® (PX) patch clamp system, for 3 h with a calculated t½=0.6 h, higher than the 1 mg/kg s.c. and i.v. doses and suitable for further in vivo testing. (See, FIG. 17B).

Example 8

Ion Channel Counterscreens

Cardiac Ion Channel Counterscreens (hERG and hNav1.5).

Cardiac ion channel counterscreens (hERG and hNav1.5) were conducted as described below, for which representative results are shown in FIGS. 18 and 19A-B.

Counterscreen Against the Cloned Human Nav1.5 Sodium Channel Using the PatchXpress® Patch Clamp System.

Cell Line.

HEK293 cells stable transfected with human hNav1.5 were purchased from Cytomyx, Inc.

The extracellular (HB-PS) recording solution contained 70 mM NaCl, 67 mM N-methyl-D-glucamine, 4 mM KCl, 1.8 mM $CaCl_2$, 1 mM $MgCl_2$, 10 mM HEPES, 10 mM Glucose adjusted to pH 7.4 with HCl. The internal recording solution contained 130 mM CsF, 10 mM NaCl, 10 mM EGTA, 2 mM $MgCl_2$, 10 mM HEPES adjusted to pH 7.20 with CsOH. Stock solutions of reference standard or test articles were diluted into HB-PS prior to application. Test articles included either peptides or peptide conjugates described herein. A standardized step protocol was used to elicit ionic current through the hNav1.5 sodium channel. Cells are held at −80 mV. Onset and steady state block of hNav1.5 sodium current due to Test Article was measured using a pulse pattern with fixed amplitudes (conditioning prepulse: −120 mV for 50 ms; depolarizing test step to −30 mV for 20 ms) repeated at 10-s intervals. Currents were acquired at 10 kHz and filtered at 3 kHz, in episodic mode. When whole cell configuration was established, cells were washed for 3 minutes, followed by applying control vehicle for 5 minutes. The DataStable_PC function of the PatchXpress scripting utility with then allow the experiment to begin only when the baseline current was stable or an additional 5 minutes had elapsed. Then control and each concentration of test article was applied for 5 minutes. There were 3 additions for each concentration with 1-minute interval. To determine $IC_{50}$, Test Article at 1 μM, 3 μM, 10 μM and 30 μM was applied to cells cumulatively (without washout between test article concentrations; n≥3 where n=number of cells). Electrophysiological data acquisition was performed using PatchXpress Commander v1.4 (Molecular Devices, Sunnyvale, Calif.) and analyses was performed using DataXpress v2.04 (Molecular Devices, Sunnyvale, Calif.). The three peak inward currents before and after test article application were used to calculate the percentage of current inhibition at each concentration. Acceptance criteria for a good recording include: (1) seal resistance>200 MΩ, (2) access resistance<10 MΩ, (3) peak tail current>200 pA, (4) leakage current<25% of the peak tail current, (5) rundown<2.5%/minute in control vehicle.

Counterscreens Against the Human IKr (hERG) Potassium Channel Using the PatchXpress® Patch Clamp System.

Cell Culture.

HEK293 cells stably expressing human ERG (hERG) potassium channel were purchased from Millipore (Cat. # CYL3039). Growth media for the HEK-hERG cells contains DMEM/F12 (Invitrogen #11320), 1X Non Essential Amino Acid (Gibco #11140), 10% Fetal Bovine Serum (Gibco #16000) and 400 μg/ml geneticin (Gibco #10131-027). Cells were maintained in culture at 37° C. in a humidified 95% air, 5% $CO_2$ environment. Seeding density for a T75 Corning flask is four million cells, and a subcultivation ratio of 1:3 is performed twice weekly or whenever the cell density reaches 80% confluency. Cells are lifted from a T75 flask on the day of PatchXpress 7000A® patch clamp system experiments by using 0.05% trypsin-EDTA (Sigma) for 3 minutes at 37° C. They are then re-suspended in growth media for at least thirty minutes at 37° C. in a humidified 95% air, 5% $CO_2$ atmosphere before loading onto the SealChip recording chambers (AVIVA Biosciences).

Electrophysiology Recording by PatchXpress 7000A Patch Clamp System (Molecular Devices).

The intracellular solution for whole cell patch clamp recordings contained (in mM) potassium chloride (70), potassium fluoride (60), magnesium chloride (2), ethylene glycol tetraacetic acid (EGTA, 11), magnesium adenosine triphosphate (5) and HEPES (10). The pH was adjusted to 7.2 with KOH, and the final osmolarity was set at 295 mOsm. The extracellular solution contains (in mM) sodium chloride (135), potassium chloride (4), magnesium chloride (1), calcium chloride (1.8), HEPES (10) and glucose (10). pH is adjusted to 7.4 with NaOH, and the final osmolarity was set at 305 mOsm.

After achieving whole cell recording mode, cells are held at a holding potential of −80 mV. A voltage step to −50 mV from holding voltage of −80 mV for 500 msec is used to establish a baseline or reference point for the peak outward tail current measurement. This is followed by a depolarizing step to +30 mV for 2 s to drive the channels to the inactivated state. A step back to −50 mV for 2 s removes inactivation and thereby revealing the maximum peak outward tail current. Voltage steps are repeated once every 10 sec. Total hERG outward tail current is determined by the difference between the peak outward tail current at the repolarizing −50 mV step and the first baseline current at −50 mV prior to channel activation.

Test Sample Preparation.

Test compounds (up to 10 μM), which included the peptides and peptide conjugates described herein, were serially diluted into the extracellular recording buffer containing 0.1% w/v bovine serum albumin (BSA) and subsequently transferred to glass perfusion reservoirs. Three μL of the serial dilutions were then transferred to nine hundred μL of assay buffer containing 0.1% w/v BSA in assay buffer.

PatchXpress® Patch Clamp System Procedure.

Cumulative concentration response curve is generated from 4 concentrations (0.3, 1, 3, and 10 μM) for drug potency measurement. Each concentration of the test compound is added 3 times separated by 60 sec to ensure complete exchange of assay buffer in the recording chamber. There is a three minute wait time between subsequent additions. Prior to test compound addition, two glass vials containing assay buffer and vehicle control (0.3% DMSO) are used as controls (i.e., 1× assay buffer, 1×0.3% DMSO, and 4 escalating concentrations of test compound).

Data Analysis.

Outward hERG tail current from every successful whole cell recording must be visually inspected for quality. The general criteria for good quality recordings are: 1) holding current at −80 mV must not exceed 300 pA during the drug addition procedure, 2) peak outward tail current must be greater than 300 pA and 3) peak outward tail current does not change by greater than 2.5%/min during the eight minute control period in 0.3% DMSO. Potency estimates are generated by Protocol Engine (Amgen) using nonlinear mixed models to quantify the consistency of the assay from cell to cell and to provide an accurate measurement of drug potency over the population of the same cell type (Miu et al., 2006, JALA 11:195).

Results of counterscreen for GpTx-1 (SEQ ID NO:1) and [Ala5]GpTx-1 (SEQ ID NO:22) against hERG are shown in FIG. 18. Results of counterscreen for GpTx-1 (SEQ ID NO:1) and [Ala5]GpTx-1 (SEQ ID NO:22) against hNav1.5 are shown in FIGS. 19A and 19B.

Example 9

In Vivo Pain Models

The compositions of the present invention can be tested in any relevant in vivo pain models. Examples include:

Tactile Allodynia-Von Frey Test.

Von Frey filaments are used to assess mechanical sensitivity in rodents. Mice are placed on a wire mesh floor, enclosed in an individual testing chamber and allowed to acclimate until calm. Calibrated filaments of various bending forces are then applied to the paw of a mouse to measure the response to a non-noxious tactile (e.g., touch) stimulus. The pattern of responses and non-responses to the series of filaments determines the animal's mechanical threshold. This threshold is used as the endpoint of the assay.

Rat Neuropathic Pain Model.

Male Sprague-Dawley rats (200 g) are anesthetized with isoflurane inhalant anesthesia and the left lumbar spinal nerves at the level of L5 and L6 are tightly ligated (4-0 silk suture) distal to the dorsal root ganglion and prior to entrance into the sciatic nerve, as first described by Kim and Chung (An experimental model for peripheral neuropathy produced by segmental spinal nerve ligation in the rat. Pain 50:355-363, (1992)). The incisions are closed and the rats are allowed to recover. This procedure results in mechanical (tactile) allodynia in the left hind paw as assessed by recording the pressure at which the affected paw (ipsilateral to the site of nerve injury) is withdrawn from graded stimuli (von Frey filaments ranging from 4.0 to 148.1 mN) applied perpendicularly to the plantar surface of the paw (between the footpads) through wire-mesh observation cages. A paw withdrawal threshold (PWT) is determined by sequentially increasing and decreasing the stimulus strength and analyzing withdrawal data using a Dixon non-parametric test, as described by Chaplan, S. R., et al. (Quantitative assessment of tactile allodynia in the rat paw. J. Neurosci. Meth, 53:55-63 (1994)).

Rat CFA Inflammatory Pain Model.

Male Sprague-Dawley rats (200 g) are injected in the left hindpaw with complete Freund's adjuvant (CFA). This procedure results in mechanical (tactile) and thermal allodynia in the left hind paw as assessed by recording the pressure at which the affected paw is withdrawn from graded stimuli (von Frey filaments ranging from 4.0 to 148.1 mN) applied perpendicularly to the plantar surface of the paw (between the footpads) through wire-mesh observation cages or by applying radiant heat. PWT is determined by sequentially increasing and decreasing the stimulus strength and analyzing withdrawal data using a Dixon non-parametric test, as described by Chaplan et al. (1994). Rats are included in the study only if they do not exhibit motor dysfunction (e.g., paw dragging or dropping) or broken skin and their PWT is below 39.2 mN (equivalent to 4.0 g). At appropriate times after CFA injection rats are treated with test peptides and/or test vehicle-conjugated peptides (usually a screening dose of 60 mg/kg) or control solution (PBS or other vehicle) once by s.c. injection and PWT is determined. Average paw withdrawal threshold (PWT) was converted to percent of maximum possible effect (% MPE) using the following formula: % MPE=100*(PWT of treated rats−PWT of control rats)/(15-PWT of control rats). Thus, the cutoff value of 15 g (148.1 mN for mechanical allodynia) is equivalent to 100% of the MPE and the control response is equivalent to 0% MPE.

Preferred molecules of the present invention are expected to produce an antinociceptive effect with a PD with appropriate exposures compared to $IC_{50}$ on the target.

Mouse Formalin Pain Model Experimental Procedure.

Formalin injection into a rodent paw evokes a well-studied form of pain quantitated by the number of times the animal flinches its paw. The pain following formalin injection comes in two characteristic phases: a first phase lasts approximately ten minutes and likely corresponds to the immediate pain mediated by peripheral neurons. The second phase, beginning approximately ten minutes after formalin injection and lasting for another 30 to 40 minutes, corresponds to sensitization of neurons in the spinal cord and hyperactivity of peripheral pain-sensing neurons. Compounds represented in this application were tested to see if they reduce the number of flinches in phase II of the formalin response and so are potential analgesic drugs (Bregman H et al., "Identification of a potent, state-dependent inhibitor of Nav1.7 with oral efficacy in the formalin model of persistent pain." J Med Chem 54(13):4427-4445, 2011).

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020×) and water and were maintained on a 12-h light/dark cycle for the entire duration of the study. All animals were housed on standard solid-bottomed caging with corn cob bedding in groups of 4 animals per cage. The animal colony was maintained at approximately 21° C. and 60% humidity. All experiments were conducted in accordance with the International Association for the Study of Pain guidelines.

On test day, during or before acclimation, the animals were dosed with either an investigational compound or vehicle. Following dose administration, all mice (n=12) were conditioned to behavioral analysis chambers (dimensions: 10 cm diameter, 14 cm tall cylinder with lid on top of elevated glass) for 5 minutes prior to the formalin injection. Video cameras were set underneath for recording the mouse behavior (5 minute acclimation and 40 minute test session). At test time, mice were lightly restrained in a cloth glove and injected with 20 uL of a 2% formalin solution into the dorsal surface of the left hind paw using an insulin syringe (U100, 0.3 cc, 28-30 G). Immediately following the formalin injection, animals were returned to the chamber and observed for 40 minutes. Paw lifting/licking behavior was recorded in 5 minute intervals after which ipsilateral and contralateral paw widths were measured. After study completion animals were immediately euthanized.

In the first mouse formalin pain model study, [Ala5]GpTx-1(1-34) (SEQ ID NO:22) was dosed at 5 mg/kg s.c. 1-hour pre-treatment with morphine at 1 mg/kg s.c. 30-min pre-treatment as the positive control. (See, FIG. 59). The peptide had no effect in the first or acute phase (0-5 minutes post formalin injection). (See, FIG. 60). The peptide significantly reduced the time spent lifting and/or licking the affected paw during the second phase (5-40 minutes post formalin injection) compared to vehicle (PBS). (See, FIG. 61). In this experiment the 1 mg/kg s.c. dose of morphine used as a positive control did not significantly reduce pain response in the animals, and it was increased to 3 mg/kg in the following studies. The terminal plasma exposure (peptide plasma concentrations at 45 min post formalin injection) for the peptide was 0.80±0.21 μM. Neither the peptide nor the morphine positive control significantly reduced the paw edema caused by formalin injection relative to the vehicle (PBS). (See, FIG. 62).

The mouse formalin pain model was repeated with 1-hour pre-treatment doses of 5, 1.67, and 0.5 mg/kg s.c. to determine the dose response of [Ala5]GpTx-1(1-34) (SEQ ID NO:22). (See, FIG. 63). The peptide had no effect at any dose in the first phase (0-5 minutes post formalin injection). (See, FIG. 64). The positive control, a 3 mg/kg s.c. dose of morphine, did significantly reduce the time spent lifting/licking the affected paw in the first phase. The 5 mg/kg s.c. dose of [Ala5]GpTx-1(1-34) (SEQ ID NO:22) demonstrated a significant reduction of the time spent lifting/licking in the second phase of the study, as did the morphine positive control. (See, FIG. 65). However, the lower peptide doses (1.67 and 0.5 mg/kg s.c.) had no significant effect relative to the vehicle in the second phase. Terminal exposures (peptide plasma concentrations at 45 min post formalin injection) were 0.58±0.26 μM, 0.15±0.05 μM, and 0.04±0.2 μM for the 5.0, 1.67, and 0.5 mg/kg doses, respectively. Neither the peptide nor the morphine positive control significantly reduced the paw edema caused by formalin injection relative to the vehicle (PBS). (See, FIG. 66). In the first two mouse formalin experiments, [Ala5]GpTx-1(1-34) (SEQ ID NO:22) demonstrated a significant reproducible reduction in paw lifting/licking at plasma concentrations between 0.60-0.80 μM. One other peptide was tested in the formalin pain model, [Glu29]GpTx-1(1-34) (SEQ ID NO:30). The substitution of glutamic acid for tryptophan at position 29 greatly reduces potency against Nav1.7, so [Glu29]GpTx-1 was prepared and tested as a negative control. A 5 mg/kg s.c. dose of [Glu29]GpTx-1 had no significant effect on the time spent lifting/licking in the formalin pain model in mice with a terminal mean peptide plasma concentration of 0.502±0.271 μM, demonstrating that peptide Nav1.7 potency correlates with efficacy in the formalin pain model. (See, FIGS. 95-98).

The mouse formalin pain model was repeated with 1-hour pre-treatment doses of 5, 3, and 1 mg/kg s.c. to further investigate the dose response of [Ala5]GpTx-1(1-34) (SEQ ID NO:22). (See, FIG. 67). The peptide had no effect at any dose in the first phase (0-5 minutes post formalin injection). (See, FIG. 68). The 5 mg/kg s.c. dose of peptide demonstrated a significant reduction of the time spent lifting/licking in the second phase of the study, as did the morphine positive control. However, the lower peptide doses did not show a reduction in lifting/licking behavior relative to the vehicle control in the second phase. The 1 mg/kg s.c. group was not significantly different from the vehicle control whereas the 3 mg/kg s.c. group appeared to significantly increase time spent lifting/licking (See, FIG. 69). Terminal exposures (peptide plasma concentrations at 45 min post formalin injection) were 1.84±0.18 μM, 0.53±0.23 μM, and 0.20±0.05 μM for the 5, 3, and 1 mg/kg doses, respectively. Neither the peptide nor the morphine positive control significantly reduced the paw edema caused by formalin injection relative to the vehicle (PBS). (See, FIG. 70).

Mouse Open Field Analysis Experimental Protocol.

To verify that efficacy in the formalin model produced by a test compound is not due to sedation or damage to the animal, compounds were also tested for their effects on the overall movement of animals (open-field testing). Naïve animals are administered test compound and placed in a novel environment, and the movements the animal undergoes during exploration of the novel environment are automatically recorded. Reductions in movement of 50% or more mean that efficacy in the formalin test cannot be ascribed to true analgesia.

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020×) and water and were maintained on a 12-h light/dark cycle for the entire duration of the study. All animals were housed on standard solid-bottomed caging with corn cob bedding in groups of 4 animals per cage. The animal colony was maintained at approximately 21° C. and 60% humidity. All experiments were conducted in accordance with the International Association for the Study of Pain guidelines.

On test day, animals were dosed with either an investigational compound or vehicle and given at least 30 minutes to acclimate to the testing room. Mice (N=8) were placed in a clean open field chamber (Kinder Scientific Photobeam Activity System) at the appropriate time after dose administration. The changes in overall animal movement were recorded on the system for 60 minutes under lights off conditions. The following parameters were evaluated: total basic movement, total rearing, total time rearing, and total fine movement.

Results of the Open Field Analysis.

[Ala5]GpTx-1(1-34) (SEQ ID NO:22) at 3 mg/kg s.c. dose with a 1-hour pre-treatment time had no effect on the total basic movement, total fine movement, total rearing, or total time rearing in CD-1 mice. No doses of peptide significantly decreased exploratory behavior in relation to the vehicle control. However, at a 5 mg/kg s.c. dose with a 1-hour pre-treatment the peptide significantly reduced the total fine movement and total time rearing components of locomotor activity in CD-1 mice relative to the vehicle. Total basic movement and total rearing were also reduced. (See, FIGS. 71-74). Terminal exposures (peptide plasma concentrations at 2 h post peptide injection) were 1.79±0.38 μM and 0.89±0.33 μM for the 5 and 3 mg/kg s.c. doses, respectively. In this experiment, the 3 mg/kg dose, which had no significant effect on locomotor activity, resulted in a peptide plasma concentration equivalent to those that had demonstrated reproducible efficacy in the formalin pain model. Higher peptide plasma concentrations (>1.5 μM) resulted in significant effects on locomotor activity, as was demonstrated by a repeat open field analysis of [Ala5]GpTx-1(1-34) (SEQ ID NO:22) at a 5 mg/kg dose with a terminal exposure of 2.1±0.47 μM. (See, FIGS. 99-102). Three other peptides were tested in the open field analysis: [Glu29]GpTx-1(1-34) (SEQ ID NO:30), [Glu28]GpTx-1(1-34) (SEQ ID NO:153), and [Ala5,Phe6,Glu10,2-Abu13,Leu26,Arg28]GpTx-1 (SEQ ID NO:1035). The substitution of glutamic acid for tryptophan at position 29 greatly reduces potency against Nav1.7, so [Glu29]GpTx-1 (SEQ ID NO:30) was prepared and tested as a negative control. A 5 mg/kg s.c. dose of [Glu29]GpTx-1 had no significant effect on the locomotor activity of mice in the open field analysis with a terminal mean peptide plasma concentration of 0.771±0.272 μM. (See, FIGS. 103-106). A 5 mg/kg dose of [Glu28]GpTx-1(1-34) (SEQ ID NO:153) significantly reduced locomotor activity in the open field analysis with a terminal mean peptide plasma concentration of 1.28±0.403 μM, similar to the result with the 5 mg/kg dose of [Ala5]GpTx-1 (SEQ ID NO:22). (See, FIGS. 107-110). A 5 mg/kg dose of [Ala5,Phe6,Glu10,2-Abu13,Leu26,Arg28] GpTx-1 (SEQ ID NO:1035) in the open field analysis resulted in moribund behavior or lethality in animals at a terminal mean peptide plasma concentration of 1.72±0.313 μM.

Mouse Veratridine Pain Model Experimental Protocol.

Veratridine is a nonselective activator of voltage-gated sodium ion channels (Hille B, Ion Channels of Excitable Membranes, Sinauer Associates, Sunderland Mass. 2001) that causes a painful flinching (paw licking and lifting or guarding) response when injected into the rodent paw. Accordingly, testing compounds like those of the present invention that are sodium channel inhibitors quantifies not only their effect on pain, but on pain caused by sodium channel activation. That is, effects of a test compound on veratridine-induced paw lifting and licking not only measures analgesic efficacy but the in vivo receptor occupancy of sodium channels.

Male CD-1 mice (8-12 weeks of age, Harlan Laboratories, Frederick, Md.) were used for all in vivo efficacy experiments. Animal subjects had free access to food (Teklad Global Soy Protein-Free Extruded Rodent Diet 2020×) and water and were maintained on a 12-h light/dark cycle for the entire duration of the study. All animals were housed on standard solid-bottomed caging with corn cob bedding in groups of 4 animals per cage. The animal colony was maintained at approximately 21° C. and 60% humidity. All experiments were conducted in accordance with the International Association for the Study of Pain guidelines.

On test day, during or before acclimation, the animals were dosed with either an investigational compound or vehicle. Following dose administration, all mice (n=12) were conditioned to behavioral analysis chambers (dimensions: 10 cm diameter, 14 cm tall cylinder with lid on top of elevated glass) for 5 minutes prior to the veratridine injection. Video cameras were set underneath for recording the mouse behavior (5 minute acclimation and 20 minute test session). At test time, mice were lightly restrained in a cloth glove and injected with 20 uL of 1 μg of veratridine (Sigma-Aldrich #V109) in 1% ethanol in phosphate buffered saline suspension into the dorsal surface of the left hind paw using an insulin syringe (U100, 0.3 cc, 28-30 G). Immediately following the veratridine injection, animals were returned to the chamber and observed for 20 minutes. Paw lifting/licking behavior was recorded in 5 minute intervals after which ipsilateral and contralateral paw widths were measured. After study completion animals were immediately euthanized.

In the first mouse veratridine pain model, [Ala5]GpTx-1 (1-34) (SEQ ID NO:22) was dosed at 5 mg/kg s.c. with a 1-hour pre-treatment time, and mexiletine was dosed at a 30 mg/kg intraperitoneal ("i.p.") dose with a 30 minute pre-treatment time as a control. The antinociceptive effect was measured on the veratridine-induced (1 μg injection in the dorsal paw) spontaneous nociceptive behaviors in CD-1 mice. Overall there was a good paw lifting response from the vehicle group that was significantly reversed with mexiletine. At 5 mg/kg, [Ala5]GpTx-1(1-34) (SEQ ID NO:22) was unable to significantly reduce the lifting behavior. (See, FIG. 75). There is no reduction of paw edema across all groups. (See, FIG. 76). However, in examining the time course of the experiment the peptide did appear to have some effect during the 10-15 and 15-20 minute time bins. (See, FIG. 77). Terminal exposure (peptide plasma concentration at 1.5 h post peptide injection) was 0.70±0.10 μM for the 5 mg/kg dose.

In the repeat of the mouse veratridine pain model, [Ala5] GpTx-1(1-34) (SEQ ID NO:22) was dosed at 1 and 5 mg/kg s.c. with a 1-hour pre-treatment time, and mexiletine was dosed at a 30 mg/kg i.p. dose with a 30 minute pre-treatment time as a control. There was a robust paw lifting response from the vehicle group that was significantly reversed with mexiletine. At 1 and 5 mg/kg, [Ala5]GpTx-1(1-34) (SEQ ID NO:22) had no effect of the lifting behavior. (See, FIG. 78). There was no reduction of paw edema in any of the groups. (See, FIG. 79). The peptide doses had no significant effect throughout the time course of the experiment. (See, FIG. 80). Terminal exposures (peptide plasma concentration at 1.5 h post peptide injection) were 0.72±0.13 μM and 0.09±0.05 μM for the 5 and 1 mg/kg doses, respectively.

The foregoing example of in vivo pain models for the screen of therapeutic embodiments of the inventive molecules are non-limiting. The skilled practitioner is aware of other relevant pain models.

Example 10

Preliminary Cardiac Safety Assessment

Isolated Perfused Rabbit Heart (Langendorff Preparation).

The effects of [Ala5]GpTx-1(1-34) (SEQ ID NO:22) in the isolated perfused rabbit heart (Langendorff preparation) assay were determined as described below, for which results are shown below in Table 36 and Table 37.

TABLE 36

Effects of 1 μM [Ala5]GpTx-1(1-34) (SEQ ID NO: 22) on electrocardiography intervals in the isolated perfused rabbit heart assay (Langendorff preparation). The peptide had no delaying effects on ventricular repolarization (QTc or JTc intervals). The peptide had no effects on heart rate (HR). The peptide also had no effects on ventricular depolarization and conduction (QRS and PR intervals). (Abbreviations: HR, heart rate; PR interval, time interval from onset of atrial depolarization (P wave) to onset of ventricular depolarization (QRS complex); QRS duration, time interval from onset to end of QRS complex, which is the duration of ventricular depolarization; QT interval, time interval from onset of QRS complex to end of T wave, which is the duration of ventricular depolarization and repolarization; QTc interval, QT interval corrected with HR; JT interval, the difference between QT interval and QRS duration (JT = QT-QRS), which is the duration of ventricular repolarization; and JTc interval, JT interval corrected with HR.)

STATISTICS (NORMALIZED VALUES). %

| Treatment | HR | PR | QRS | QT | QTcF | JT | JTcF |
|---|---|---|---|---|---|---|---|
| Mean | | | | | | | |
| 1% BSA | 0.00 | 0.00 | 0.00 | 0.00 | 0.00 | 0.00 | 0.00 |
| 1 uM SEQ ID NO: 22 | −0.18 | −3.52 | −1.55 | −4.19 | −4.22 | −4.57 | −4.60 |
| Standard Deviation | | | | | | | |
| 1% BSA | 0.00 | 0.00 | 0.00 | 0.00 | 0.00 | 0.00 | 0.00 |
| 1 uM SEQ ID NO: 22 | 1.87 | 2.19 | 2.66 | 2.48 | 2.10 | 3.12 | 2.75 |

TABLE 37

Effects of 1 μM [Ala5]GpTx-1(1-34) (SEQ ID NO: 22) on hemodynamic parameters in the isolated perfused rabbit heart assay (Langendorff preparation). The peptide had no effects on LV contractility (dP/dt+) and no effects on coronary blood flow (CF). The peptide had no direct effects on coronary vasculature. (Abbreviations: LVSP, left ventricular systolic pressure; LVDP, left ventricular diastolic pressure; dP/dt+, maximal rate of increase in LV pressure; dP/dt−, minimal rate of decrease in LV pressure; LVDevP, LV developed pressure, LVDevP = LVSP-LVDP; and CF, Coronary flow.)

| LVP. Normalized Values (%) | | | | | | | |
|---|---|---|---|---|---|---|---|
| uM | LVSP, mean | LVDP, mean | dP/dt+, mean | dP/dt−, mean | Flow, mean | LVDevP | N |
| Baseline | 1.64 | 0.02 | 1.72 | 2.60 | 0.04 | 1.89 | 4 |
| 1 uM SEQ ID NO: 22 | −8.81 | −3.16 | −6.55 | −2.93 | 0.29 | −7.22 | 4 |

| LVP.Standard Deviation | | | | | | | |
|---|---|---|---|---|---|---|---|
| uM | LVSP, SD | LVDP, SD | dP/dt+, SD | dP/dt−, SD | Flow SD | LVDevP, SD | N |
| Baseline | 2.13 | 0.40 | 1.61 | 3.66 | 0.45 | 2.51 | 4 |
| 1 uM SEQ ID NO: 22 | 1.41 | 7.15 | 2.72 | 0.93 | 7.99 | 1.10 | 4 |

Acquisition and Acclimatization.

Six female New Zealand White rabbits, 14-22 weeks old and 2.5-3.5 kg were obtained from Harlan Laboratories. Upon receipt, rabbits were examined by veterinary personnel to ensure acceptable health status. Veterinary care was provided by the veterinarians and staff. Rabbits were acclimated for at least 7 days prior to use. Unhealthy rabbits were not used for the study.

Method of Identification.

Each rabbit was assigned an identification number by the supplier. An ear tag containing the identification number was affixed to each rabbit by the supplier. This identification number was displayed on a cage card, along with the rabbit's date of arrival, date of birth, source, and sex. The identification numbers of the rabbits used in the study and their final weights were recorded in notebooks. *Composition of Perfusion Medium*. The perfusion medium consists of modified oxygenated Krebs-Henseleit buffer (37° C. at the heart) composed of (mM): NaCl (120), KCl (4.7), $MgSO_4$ (1.2), $KH_2PO_4$ (1.2), d-glucose (11.1), $CaCl_2$ (1.8), $NaHCO_3$ (25), and Na-pyruvate (2.0). This perfusion medium is constantly bubbled with 95% $O_2$/5% $CO_2$. For testing [Ala5]GpTx-1(1-34) (SEQ ID NO:22), 1% BSA was added in the buffer.

Anesthesia and Heart Removal.

Each rabbit was anaesthetized with pentobarbital (50 mg/kg, IV; ear vein). Complete suppression of pain was assessed by pinching a paw (pedal withdrawal reflex). Rabbits were restrained in a rabbit cage restrainer while anesthesia induction was taking place to avoid injury to the animal and the investigator.

Exposing the heart: Once the animal was anesthetised the heart was excised. The diaphragm was accessed by a trans-abdominal incision and cut carefully to expose the thoracic cavity. The thorax was opened by a bilateral incision along the lower margin of the last to first ribs, the thoracic cage was then reflected over the animals head, exposing the heart. To remove the heart, the organ was cradled gently between the fingers to avoid injury and lifted slightly before incising the aorta, vena cava and pulmonary vessels.

Isolated Heart Preparation Perfused by Langendorff Apparatus.

Hearts were rapidly removed, mounted on a Langendorff apparatus, and perfused with oxygenated Krebs-Henseleit buffer under constant pressure. Spontaneously beating (unpaced) hearts were included in the study if they exhibited acceptable and stable baseline values for each parameter (mechanical, heart rate, cardiac interval, etc) during the equilibration period. Perfusion buffer temperature was maintained ~37° C. throughout the study period.

Experimental Plan.

Each individual heart (N=4 total) was equilibrated for approximately 30 to 60 minutes. Following this equilibration period, baseline measurements were collected for approximately 10 minutes in 1% BSA. After this period, hearts were exposed to [Ala5]GpTx-1(1-34) (SEQ ID NO:22) at 1 μM for 20 minutes. Cardiac parameters were measured continuously during the study using a computerized data acquisition system. (See Qu et al., BeKm-1, A Peptide Inhibitor of hERG potassium currents, prolongs QTc intervals in isolated rabbit heart, J. Pharmacol. Exp. Ther. (337):2-8 (2011) for details and validation studies.)

Electrocardiographic Measurements.

Simultaneous 2-lead surface-contacted electrocardiograms were recorded with flexible unipolar electrodes placed on the heart, one over the epicardium of ventricles and the other over the epicardium of the left atria.

Hemodynamic Measurements.

The latex balloon in the left ventricle (LV) was expanded with water to achieve a LVEDP of approximately 5-10 mmHg. The balloon was connected with tubing to a pressure transducer to measure LVEDP and LVSP. Coronary perfusion pressure (CPP) was measured with a pressure transducer connected to a side-arm port of the aortic block.

Data Analysis.

For analysis, left ventricular pressure (LVP) and CPP were automatically performed with Notocord. Measurements from the final 30 sec of the equilibration period and each dose exposure period were evaluated and used to determine effects. Electrocardiograms (ECGs) were analyzed with EMKA ecgAUTO software (EMKA Technologies, Paris, France) and 1 minute consecutive ECG waveforms (30 seconds before the next event marker) were analyzed for HR, PR, QRS and QT intervals. Values from each individual heart were pooled to determine an average for each variable at individual concentrations. Average percent change of each variable between baseline and each concentration were also determined. For HR correction of QT intervals, Fridericia's equation was used ($QTcF=QT/RR^{1/3}$). Data are presented as average percent change of each variable between baseline and each concentration. A ≥10% change in HR, PR, QRS, QTc, and JTc and a ≥15% change in +dP/dt and CF are considered drug-related. All values are presented as mean±S.D.

Results.

At a 1 μM concentration, [Ala5]GpTx-1(1-34) (SEQ ID NO:22), had no effects in the isolated perfused rabbit heart assay (Langendorff preparation). The peptide had no delaying effects on ventricular repolarization (QTc or JTc intervals) and had no effects on heart rate. The peptide also had no effects on ventricular depolarization and conduction (QRS and PR intervals). The peptide had no effects on LV contractility (dP/dt+) and no effects on coronary blood flow (CF). The peptide had no direct effects on coronary vasculature.

Example 11

Site Specific Peptide Conjugation

The following protocol was used to site-specifically conjugate toxin peptide analogs (see, Table 5A and Table 5B for toxin peptide analog amino acid sequences) to either a human immunoglobulin at a linkage site on the heavy chain (C273 of SEQ ID NO:3087) or on a human immunoglobulin Fc domain (at C52 of SEQ ID NO:3089).

Preparation of Peptide-Linker Constructs.

Alkyne-containing peptides were subjected to copper catalyzed 1,3-dipolar cycloaddition with azido-PEG bromoacetamides of two differing lengths to obtain the site-specifically PEGylated peptides with a triazole linkage, thus converting a propargylglycine or Pra residue in the sequence to a 3-(1,2,3-triazol-4-yl)alanine or Atz residue. (See, FIG. 81B). Peptide containing either propargylglycine (Pra) at position 13 or 4-pentynoyl (4-Pen) at the N-terminus (7.4 mM in 6.7 mL water), azido-PEG11-bromoacetamide (150 mM, 0.964 mL in water), tris((1-benzyl-1H-1,2,3-triazol-4-yl)methyl)amine (TBTA, 10 mM, 2.2 mL in DMSO), sodium ascorbate (50 mM, 10.1 mL in water), and copper (II) sulfate (35 mM, 2.9 mL in water) solutions were prepared fresh. Peptide and reagents were added in the following order to a 50 mL centrifuge tube to achieve the following final concentrations. Peptide stock solution (6.7 mL) was added for a final concentration of 3.7 mM, followed by addition of azido-PEG11-bromoacetamide (0.402 mL) for a final concentration of 4.5 mM. TBTA (0.603 mL) was added for a final concentration of 0.45 mM and mixed thoroughly. Sodium ascorbate (4.522 mL) was then added for a final concentration of 16.9 mM and mixed thoroughly. $CuSO_4$ (1.292 mL) was added for a final concentration of 3.4 mM. The solution was allowed to stand for 1 h at which time it was judged to be complete by LC-MS. To a 25 mL SPE filter tube was added SP Sepharose High Performance as a slurry (8 mL) with a pipette. The gel was conditioned with wash buffer (50 mL 20 mM NaOAc, pH=4.0), loaded with the peptide solution, washed (50 mL, 20 mM NaOAc, pH=4.0 and 50 mL, 20 mM NaOAc, pH=4.0, 0.1M NaCl), and eluted with 45 ml 1M NaCl, 20 mM NaOAc, pH=4.0) into a 50 mL centrifuge tube. The product mixture was purified by loading onto a preparative HPLC column (Phenomenex Luna 5u C18(2) 100A AXIA, 250×30 mm) at 30 mL/min using an Agilent prep loading pump. The column was flushed for 10 min with 10% B. The column was attached to a prep HPLC (Agilent), and the peptide was eluted with a 10-40% B gradient over 60 min, followed by a 10 min flush and a 10 min equilibration. The fractions were analyzed by LC-MS, pooled, and lyophilized to afford pure peptide-linker construct for conjugation to IgG or Fc domain.

Antibody Preparation/Reduction.

Anti-DNP mAb (E273C, hIgG1) (kappa/IgG1z) was concentrated to ~5 mg/ml in reaction buffer (20 mM sodium phosphate pH 6.8, 2 mM EDTA).

The amino acid sequence of the human IgG heavy chain monomer that was used was the following (variable region is underlined; C273 linkage site is italicized and underlined):

SEQ ID NO.: 3087

QVQLVESGGGVVQPGRSLRLSCAASGFTFSSYGMHWVRQAP

GKGLEWVAVIWYDGSNKYYADSVKGRFTISRDNSKNTLYLQMNSLRAED

TAVYYCARYNFNYGMDVWGQGTTVTVSSASTKGPSVFPLAPSSKSTSGG

TAALGCLVKDYFPEPVTVSWNSGALTSGVHTFPAVLQSSGLYSLSSVVT

VPSSSLGTQTYICNVNHKPSNTKVDKKVEPKSCDKTHTCPPCPAPELLG

GPSVFLFPPKPKDTLMISRTPEVTCVVVDVSHEDPCVKFNWYVDGVEVH

NAKTKPREEQYNSTYRVVSVLTVLHQDWLNGKEYKCKVSNKALPAPIEK

TISKAKGQPREPQVYTLPPSREEMTKNQVSLTCLVKGFYPSDIAVEWES

NGQPENNYKTTPPVLDSDGSFFLYSKLTVDKSRWQQGNVFSCSVMHEAL

HNHYTQKSLSLSPGK//

The amino acid sequence of the human IgG kappa light chain monomer that was used was the following (variable region is underlined):

SEQ ID NO.: 3088

DIQMTQSPSSVSASVGDRVTITCRASQGISRRLAWYQQKPGKAPKLLIYAA

SSLQSGVPSRFSGSGSGTDFTLTISSLQPEDFATYYCQQANSFPFTFGPGTKVDIKRTVAAP

SVFIFPPSDEQLKSGTASVVCLLNNFYPREAKVQWKVDNALQSGNSQESVTEQDSKDST

YSLSSTLTLSKADYEKHKVYACEVTHQGLSSPVTKSFNRGEC//

The amino acid sequence of the human IgG1z Fc domain monomer that was used was the following (C52 linkage site is italicized and underlined):

SEQ ID NO.: 3089

DKTHTCPPCPAPELLGGPSVFLFPPKPKDTLMISRTPEVTCVVVDVSHED

PCVKFNWYVDGVEVHNAKTKPREEQYNSTYRVVSVLTVLHQDWLNGKEYK

CKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQG

NVFSCSVMHEALHNHYTQKSLSLSPGK//.

TABLE 38

Immunoglobulin-peptide conjugates and Fc domain-peptide conjugates made. "Monovalent" conjugate molecules had one toxin peptide (i.e., peptide covalently conjugated via linker to one HC or Fc domain monomer in the molecule, but not to the other HC or Fc domain monomer) in the molecule; "Bivalent" conjugate molecules had two toxin peptides (i.e., one peptide covalently conjugated via linker to each HC or Fc domain monomer in the molecule). SEQ ID NOS: 1046, 1047, and 1048 are as set forth in Table 5A.

| Designation | SEQ ID NO of toxin peptide | Linker and residue position of linkage on toxin peptide | SEQ ID NOS of immunoglobulin monomers in conjugated molecule | Monovalent or Bivalent |
|---|---|---|---|---|
| Fc-peptide Conjugate 1 | 1046 | PEG11-(acetamidomethyl) linker at residue 13 sidechain | 3089; 3089 | Monovalent |
| Fc-peptide Conjugate 2 | 1046 | PEG11-(acetamidomethyl) linker at residue 13 sidechain | 3089; 3089 | Bivalent |
| Immunoglobulin-peptide Conjugate 1 | 1046 | PEG11-(acetamidomethyl) linker at residue 13 sidechain | 3087; 3088; 3087; 3088 | Monovalent |
| Immunoglobulin-peptide Conjugate 2 | 1046 | PEG11-(acetamidomethyl) linker at residue 13 sidechain | 3087; 3088; 3087; 3088 | Bivalent |
| Fc-peptide Conjugate 3 | 1047 | PEG11-(acetamidomethyl) linker at residue 13 sidechain | 3089; 3089 | Monovalent |
| Fc-peptide Conjugate 4 | 1047 | PEG11-(acetamidomethyl) linker at residue 13 sidechain | 3089; 3089 | Bivalent |
| Immunoglobulin-peptide Conjugate 3 | 1047 | PEG11-(acetamidomethyl) linker at residue 13 sidechain | 3087; 3088; 3087; 3088 | Monovalent |
| Immunoglobulin-peptide Conjugate 4 | 1047 | PEG11-(acetamidomethyl) linker at residue 13 sidechain | 3087; 3088; 3087; 3088 | Bivalent |
| Fc-peptide Conjugate 5 | 1048 | acetamidomethyl-NPEG11-triazole linker at N-terminal | 3089; 3089 | Monovalent |
| Fc-peptide Conjugate 6 | 1048 | acetamidomethyl-NPEG11-triazole linker at N-terminal | 3089; 3089 | Bivalent |
| Immunoglobulin-peptide Conjugate 5 | 1048 | acetamidomethyl-NPEG11-triazole linker at N-terminal | 3087; 3088; 3087; 3088 | Monovalent |
| Immunoglobulin-peptide Conjugate 6 | 1048 | acetamidomethyl-NPEG11-triazole linker at N-terminal | 3087; 3088; 3087; 3088 | Bivalent |
| Fc-peptide Conjugate 7 | 1046 | PEG3-(acetamidomethyl) linker at residue 13 sidechain | 3089; 3089 | Monovalent |
| Fc-peptide Conjugate 8 | 1046 | PEG3-(acetamidomethyl) linker at residue 13 sidechain | 3089; 3089 | Bivalent |
| Immunoglobulin-peptide Conjugate 7 | 1046 | PEG3-(acetamidomethyl) linker at residue 13 sidechain | 3087; 3088; 3087; 3088 | Monovalent |
| Immunoglobulin-peptide Conjugate 8 | 1046 | PEG3-(acetamidomethyl) linker at residue 13 sidechain | 3087; 3088; 3087; 3088 | Bivalent |

Reduction of engineered cysteines was done by incubating mAb with a 1:1 molar ratio of TCEP to cysteine (2:1 TECP to mAb) at room temperature for 30 minutes. TCEP was removed using a Zeba spin desalting column (≥7 kD Pierce) equilibrated with reaction buffer. Large scale preps were concentrated to appropriate volume prior to loading using amicon ultra (10,000-30,000 MWCO) centrifugal concentrators.

Peptide Preparation.

Lyophilized peptide-linker containing a bromoacetamide functionality was resuspended in water at 20 mg/ml immediately prior to conjugation reaction.

Conjugation Reaction.

Peptide and reduced mAb were mixed at a 2.5:1 molar ratio of peptide to cysteine (5:1 peptide to mAb) in reaction buffer at mAb concentration of 5 mg/ml and incubated for 12-16 hours at 4° C. The engineered free cysteines in the immunoglobulin react with the bromoacetamide functionality in peptide-linker to form a site-specific immunoglobulin-peptide conjugate with a stable thioacetamide linkage. (See, FIG. 81B and FIG. 82). If one cysteine reacts, then the result is a monovalent immunoglobulin-peptide conjugate, and if both cysteines react, then the result is a bivalent immunoglobulin-peptide conjugate Purification of Conjugates.

Following incubation, conjugation reaction was desalted to removed excess free peptide and loaded onto a HiTrap SP-HP column (GE Healthcare; 1 ml column for preps <10 mg, 5 ml column for preps >10 mg). Column was rinsed in 5 column volumes of 90% buffer A (10 mM sodium phosphate pH 6.5, 5% ethanol) 10% buffer B (10 mM sodium phosphate pH 6.5, 5% ethanol, 1M NaCl). Conjugates (see, Table 38) were eluted over a 20 column volume gradient from 10% buffer B to 70% buffer B. Unmodified mAb elutes first followed by monvalent immunoglobulin-peptide conjugate (1 peptide per mAb), followed by bivalent immunoglobulin-peptide conjugate (2 peptides per mAb). Higher order conjugates resulting from over reduction of the mAb elute later. (See, FIG. 83 for mAb immunoglobulin-peptide conjugates and FIG. 84 for Fc domain-peptide conjugates). Following purification, conjugates were formulated into A5SU storage buffer (10 mM sodium acetate pH 5.0, 9% sucrose) and concentrated to 10 mg/ml to be stored at −80° C.

Analysis of Conjugates.

Conjugates were run on reducing SDS-PAGE to confirm conjugation to heavy chain (increase in size by ~5 kD) and non-reducing SDS-PAGE to confirm internal disulfides remained intact. (See, FIG. 83 for mAb immunoglobulin-peptide conjugates and FIG. 84 for Fc domain-peptide conjugates). Conjugates were run on analytical SEC to determine if aggregation was present (Superdex-200 10/300 column in 100 mM sodium phosphate, 250 mM NaCl, pH 6.8 with isocratic elution −1 ml/min for 35 min). (See, FIG. 85).

LC-MS-TOF Analysis of Conjugates.

LC/MS spectrometry of peptide conjugates was recorded using an Agilent 6224 TOF LC/MS spectrometer with a non-reduced method. After calibration, a 5 μg intact sample was loaded onto a Zorbax 300SB C6 column (1×50 mm, 3.5 μm, Agilent Technologies) operation at 75° C. with a flow rate of 50 μl/min. Peptide-conjugate was eluted from the column using a gradient of 90% n-propanol with 0.1% TFA (Buffer B) and 0.1% TFA in water (Buffer A). The gradient condition was 20% to 90% buffer B in 14 min. (See, FIG. 86 for bivalent mAb-peptide conjugate and FIG. 87 for bivalent Fc domain-peptide conjugate). The MS spectra indicate the addition of two peptides to the immunoglobulin and immunoglobulin Fc domain, respectively. The presence of multiple peaks is due to the different glycosylation isoforms.

Specific Reaction Results.

From 100 mg of Anti-DNP mAb (E273C, hIgG1) and 15 mg of peptide-linker construct (SEQ ID NO:1062) were obtained 22 mg of bivalent conjugate (Immunoglobulin-Peptide Conjugate 2) and 11 mg of monovalent conjugate (Immunoglobulin-peptide Conjugate 1). Samples were concentrated to 10 mg/mL in ASSU buffer and stored as aliquots at −80° C.

Models of Peptide Conjugates.

For illustrative purposes only, models of Fc-peptide Conjugate 1, Fc-peptide Conjugate 2, Immunoglobulin-peptide Conjugate 1, and Immunoglobulin-peptide Conjugate 2 were created (MOE; Chemical Computing Group: Montreal, Quebec, Canada, 2010). (See, FIGS. 88-91). A homology model of the anti-DNP mAb (E273C) hIgG1 (comprising immunoglobulin monomers SEQ ID NO:3087; SEQ ID NO:3088; SEQ ID NO:3087; SEQ ID NO:3088) and anti-DNP mAb (E52C) hIgG1 Fc domain (homodimer of SEQ ID NO:3089) was constructed from an immunoglobulin crystal structure (1 HZH.pdb) using the program MOE (MOE; Chemical Computing Group: Montreal, Quebec, Canada, 2010). The sites of conjugation, Cys273 in the immunoglobulin and Cys52 in the immunoglobulin Fc domain, are indicated. The PEG11 linkers are depicted in an arbitrary conformation connecting the appropriate cysteine residue(s) in the immunoglobulin and immunoglobulin Fc domain to the Atz13 residue(s) in the peptide(s). A homology model of the peptide (SEQ ID NO:1046) was constructed from the NMR structure of GpTx-1 (MOE; Chemical Computing Group: Montreal, Quebec, Canada, 2010) and is displayed in an arbitrary relative orientation to the immunoglobulin and immunoglobulin Fc domain. One or two peptides are shown to reflect the monovalent or bivalent nature of each peptide conjugate.

Example 12

Preliminary Pharmacokinetics of Peptide Conjugates in Mice

Pharmacokinetic (PK) Studies of Toxin Peptide Conjugates.

A preliminary PK study was conducted with 7-week-old unmodified CD-1 mice from Taconic. Fc-P2 (Fc-Peptide Conjugate 2) or its control Fc (SEQ ID NO:1062) were dosed subcutaneously at 1 mg/kg or 10 mg/kg to four separate groups of twelve mice. In a separate cohort, Ab-P2 (Immunoglobulin-peptide Conjugate 2) or its control Ab (anti-DNP mAb (E273C, hIgG1; comprising immunoglobulin monomers SEQ ID NO:3087; SEQ ID NO:3088; SEQ ID NO:3087; SEQ ID NO:3088) were dosed subcutaneously at 1 mg/kg or 10 mg/kg to four separate groups of twelve mice. Subcutaneous injections were delivered at the nape of the neck. At 0.5, 1, 2, 4, 8 and 24 hours post-dose, 2 mice from each of the four dose routes were euthanized and blood samples and brains were collected. Brains were weighed and frozen at −80° C. immediately. Blood samples were collected in EDTA-treated microtainers and centrifuged at 13000 rpm for 5 minutes, after which plasma was extracted and frozen at −80° C. in a 96-well plate.

LC-MS/MS Analytical Procedure.

Peptide conjugate (Immunoglobulin-Peptide Conjugate 2 or Fc-Peptide Conjugate 2) stock solutions (100 μg/mL) were made from conjugate reference standards in DPBS with 1% BSA and stored at −20° C. Standard samples were prepared in mouse serum. Standards concentrations of 25, 50, 100, 250, 500, 1000, 2500, 5000 and 10,000 ng/mL were prepared by serial dilution of a freshly prepared 10,000 ng/mL solution in mouse serum using the 100 μg/mL peptide conjugate stock solutions. 25 μl serum samples were aliquoted into the appropriate well of a 96-well plate, followed by the addition of 25 μl of internal standard solution (1 μg/mL, αDA-IgG2 uniformly labeled with [$^{15}N$, $^{13}C_6$]-Leu made in DPBS with 1%

BSA). Plasma samples were then processed by immunoaffinity capture in 96-well plate format using magnetic beads immobilized with anti-human Fc mouse antibody, followed by trypsin digestion and solid phase extraction using an Oasis HLB µElution 96-well solid phase extraction plate to extract tryptic peptides, the extracts were injected (10 µL) onto the LC-MS/MS system for analysis.

The LC-MS/MS consisted of an Acquity UPLC system (Waters, Milford, Mass.) coupled to a 5500 QTRAP mass spectrometer (AB Sciex, Toronto, Canada) with a Turbo IonSpray® ionization source. The analytical column was an Acquity UPLC BEH $C_{18}$ (100×2.1 mm, 1.7 um). The mobile phases were 0.1% formic acid in acetonitrile/water (5/95, v/v, mobile phase A) and 0.1% formic acid in acetonitrile/water (95/5, v/v, mobile phase B). N-terminal DCLGAFR (SEQ ID NO:1050) from peptide SEQ ID NO:1062 was used as surrogate peptide for peptide conjugate (Immunoglobulin-Peptide Conjugate 2 or Fc-Peptide Conjugate 2) quantitative analysis.

Data was collected and processed using AB Sciex Analyst® software (version 1.5).

The calibration curve was derived from the peak area ratios (peptide/internal standard) using $1/x^2$ weighted linear least-squares regression of the area ratio versus the concentration of the corresponding peptide conjugate standard. The regression equation from the calibration standards was used to back calculate the measured concentration for each standard and mouse serum samples.

Results of the preliminary PK studies showed that exposures for the peptide conjugates were slightly lower than for the unmodified IgG and Fc, respectively. (See, FIG. 88 and FIG. 89). In both cases, a 10 mg/kg s.c. dose resulted in plasma concentrations at or near the in vitro Nav1.7 $IC_{50}$ of the respective peptide conjugates at 24 h. $C_{max}$ for (Fc-Peptide Conjugate 2) was reached between 8 and 24 h, but $C_{max}$ for (Immunoglobulin-Peptide Conjugate 2) occurred at or after 24 h. An accurate n vivo $t_{1/2}$ was not able to be calculated due to the brevity of the experiment. Immunoglobulin-Peptide Conjugate 2 and Fc-Peptide Conjugate 2 were both tested in the open field analysis in mice at a 10 mg/kg s.c. dose with a 24 h pre-treatment time and had no significant effect on the locomotor activity of the animals. (See, FIGS. 111-114). Immunoglobulin-Peptide Conjugate 2 and Fc-Peptide Conjugate 2 were both tested in the formalin pain model in mice at a 10 mg/kg s.c. dose with a 24 h pre-treatment time and had no significant effect on the spent lifting/licked the affected paw during either the first or second phase of the study. (See, FIGS. 115-117). It is likely that the dose was not sufficient to cover the target in vivo and observe efficacy.

ABBREVIATIONS

Abbreviations used throughout this specification are as defined below, unless otherwise defined in specific circumstances.

Ac acetyl (used to refer to acetylated residues)
AcBpa acetylated p-benzoyl-L-phenylalanine
ACN acetonitrile
AcOH acetic acid
ADCC antibody-dependent cellular cytotoxicity
Aib aminoisobutyric acid
bA beta-alanine
Bpa p-benzoyl-L-phenylalanine
BrAc bromoacetyl ($BrCH_2C(O)$
BSA Bovine serum albumin
Bzl Benzyl
Cap Caproic acid
CBC complete blood count
CNS central nervous system
COPD Chronic obstructive pulmonary disease
CTL Cytotoxic T lymphocytes
DCC Dicylcohexylcarbodiimide
Dde 1-(4,4-dimethyl-2,6-dioxo-cyclohexylidene)ethyl
DOPC 1,2-Dioleoyl-sn-Glycero-3-phosphocholine
DOPE 1,2-Dioleoyl-sn-Glycero-3-phosphoethanolamine
DPPC 1,2-Dipalmitoyl-sn-Glycero-3-phosphocholine
DRG dorsal root ganglion
DSPC 1,2-Distearoyl-sn-Glycero-3-phosphocholine
DTT Dithiothreitol
EAE experimental autoimmune encephalomyelitis
ECL enhanced chemiluminescence
ESI-MS Electron spray ionization mass spectrometry
Et ethyl
FACS fluorescence-activated cell sorting
Fmoc fluorenylmethoxycarbonyl
HOBt 1-Hydroxybenzotriazole
HPLC high performance liquid chromatography
HSL homoserine lactone
IB inclusion bodies
IWQ IonWorks® Quattro patch clamp system
KCa calcium-activated potassium channel (including IKCa, BKCa, SKCa)
KLH Keyhole Limpet Hemocyanin
Kv voltage-gated potassium channel
Lau Lauric acid
LPS lipopolysaccharide
LYMPH lymphocytes
MALDI-MS Matrix-assisted laser desorption ionization mass spectrometry
Me methyl
MeO methoxy
MeOH methanol
MHC major histocompatibility complex
MMP matrix metalloproteinase
MW Molecular Weight
MWCO Molecular Weight Cut Off
1-Nap 1-napthylalanine
Nav, $Na_V$ voltage-gated sodium channel
NEUT neutrophils
Nle norleucine
NMP N-methyl-2-pyrrolidinone
OAc acetate
PAGE polyacrylamide gel electrophoresis
PBMC peripheral blood mononuclear cell
PBS Phosphate-buffered saline
Pbf 2,2,4,6,7-pendamethyldihydrobenzofuran-5-sulfonyl
PCR polymerase chain reaction
PD pharmacodynamic
Pec pipecolic acid
PEG Poly(ethylene glycol)
Pic picolinic acid
PK pharmacokinetic
PNS peripheral nervous system
PX PatchXpress® patch clamp system
pY phosphotyrosine
RBS ribosome binding site
RT room temperature (25° C.)
Sar sarcosine
SDS sodium dodecyl sulfate
STK serine-threonine kinases
t-Boc tert-Butoxycarbonyl
tBu tert-Butyl
TCR T cell receptor
TFA trifluoroacetic acid
TG trigeminal ganglion
THF thymic humoral factor
Trt trityl
TTX tetrodotoxin

SEQUENCE LISTING (3098 sequences)

SEQ ID NO: 1 - protein, 34 aa, Grammostola porteri
  C-term Amide
DCLGFMRKCIPDNDKCCRPNLVCSRTHKWCKYVF

SEQ ID NO: 2 - protein, 34 aa, Artificial Sequence; identical to SEQ ID NO: 1
  Description of Artificial Sequence: Synthetic polypeptide
  MOD_RES (1)..(34): D-amino acids
  C-term Amide

SEQ ID NO: 3 - protein, 34 aa, Artificial Sequence
  Description of Artificial Sequence: Synthetic polypeptide
  MOD_RES (6)..(6): SeMet
  C-term Amide
DCLGFXRKCIPDNDKCCRPNLVCSRTHKWCKYVF

SEQ ID NO: 4 - protein, 34 aa, Artificial Sequence
  Description of Artificial Sequence: Synthetic polypeptide
  C-term Amide
DCLGFMRKCIPANDKCCRPNLVCSRTHKWCKYVF

SEQ ID NO: 5 - protein, 34 aa, Artificial Sequence
  Description of Artificial Sequence: Synthetic polypeptide
  C-term Amide
DCLGFMRKCIPDADKCCRPNLVCSRTHKWCKYVF

SEQ ID NO: 6 - protein, 34 aa, Artificial Sequence
  Description of Artificial Sequence: Synthetic polypeptide
  C-term Amide
DCLGFMRKCIPDNDACCRPNLVCSRTHKWCKYVF

SEQ ID NO: 7 - protein, 34 aa, Artificial Sequence
  Description of Artificial Sequence: Synthetic polypeptide
  C-term Amide
DCLGFMRKCIPDNDKCCRPALVCSRTHKWCKYVF

SEQ ID NO: 8 - protein, 34 aa, Artificial Sequence
  Description of Artificial Sequence: Synthetic polypeptide
  C-term Amide
DCLGFMRKCIPDNDKCCRPNLACSRTHKWCKYVF

SEQ ID NO: 9 - protein, 34 aa, Artificial Sequence
  Description of Artificial Sequence: Synthetic polypeptide
  C-term Amide
DCLGFMRKCIPDNDKCCRPNLVCSATHKWCKYVF

SEQ ID NO: 10 - protein, 34 aa, Artificial Sequence
  Description of Artificial Sequence: Synthetic polypeptide
  C-term Amide
DCLGFMRKCIPDNDKCCRPNLVCSRAHKWCKYVF

SEQ ID NO: 11 - protein, 34 aa, Artificial Sequence
  Description of Artificial Sequence: Synthetic polypeptide
  C-term Amide
DCLGFMRKCIPDNDKCCRPNLVCSRTAKWCKYVF

SEQ ID NO: 12 - protein, 34 aa, Artificial Sequence
  Description of Artificial Sequence: Synthetic polypeptide
  C-term Amide
DCLGFMRKCIPDNDKCCRPNLVCSRTHAWCKYVF

SEQ ID NO: 13 - protein, 34 aa, Artificial Sequence
  Description of Artificial Sequence: Synthetic polypeptide
  C-term Amide
DCLGFMRKCIPDNDKCCRPNLVCSRTHKWCAYVF

SEQ ID NO: 14 - protein, 34 aa, Artificial Sequence
  Description of Artificial Sequence: Synthetic polypeptide
  C-term Amide
DCLGFMRKCIPDNDKCCRPNLVCSRTHKWCKAVF

SEQ ID NO: 15 - protein, 34 aa, Artificial Sequence
  Description of Artificial Sequence: Synthetic polypeptide
  C-term Amide
DCLGFMRKCIPDNDKCCRPNLVCSRTHKWCKYAF

SEQ ID NO: 16 - protein, 35 aa, Artificial Sequence
  Description of Artificial Sequence: Synthetic polypeptide
  C-term Amide
DCLGFMRKCIPDNDKCCRPNLVCSRTHKWCKYVFA

SEQ ID NO: 17 - protein, 35 aa, Artificial Sequence
  Description of Artificial Sequence: Synthetic polypeptide
  C-term Amide
EDCLGFMRKCIPDNDKCCRPNLVCSRTHKWCKYVF

SEQ ID NO: 18 - protein, 34 aa, Artificial Sequence
  Description of Artificial Sequence: Synthetic polypeptide
  C-term Amide
ECLGFMRKCIPDNDKCCRPNLVCSRTHKWCKYVF

SEQ ID NO: 19 - protein, 34 aa, Artificial Sequence
  Description of Artificial Sequence: Synthetic polypeptide
  C-term Amide
DCEGFMRKCIPDNDKCCRPNLVCSRTHKWCKYVF

SEQ ID NO: 20 - protein, 34 aa, Artificial Sequence
  Description of Artificial Sequence: Synthetic polypeptide
  C-term Amide
ACLGFMRKCIPDNDKCCRPNLVCSRTHKWCKYVF

SEQ ID NO: 21 - protein, 34 aa, Artificial Sequence
  Description of Artificial Sequence: Synthetic polypeptide
  C-term Amide
DCAGFMRKCIPDNDKCCRPNLVCSRTHKWCKYVF

SEQ ID NO: 22 - protein, 34 aa, Artificial Sequence
  Description of Artificial Sequence: Synthetic polypeptide
  C-term Amide
DCLGAMRKCIPDNDKCCRPNLVCSRTHKWCKYVF

SEQ ID NO: 23 - protein, 34 aa, Artificial Sequence
  Description of Artificial Sequence: Synthetic polypeptide
  C-term Amide
DCLGFARKCIPDNDKCCRPNLVCSRTHKWCKYVF

SEQ ID NO: 24 - protein, 34 aa, Artificial Sequence
  Description of Artificial Sequence: Synthetic polypeptide
  C-term Amide
DCLEFMRKCIPDNDKCCRPNLVCSRTHKWCKYVF

SEQ ID NO: 25 - protein, 34 aa, Artificial Sequence
  Description of Artificial Sequence: Synthetic polypeptide
  C-term Amide
DCLGFMRECIPDNDKCCRPNLVCSRTHKWCKYVF

SEQ ID NO: 26 - protein, 34 aa, Artificial Sequence
  Description of Artificial Sequence: Synthetic polypeptide
  C-term Amide
DCLGFMRKCIPENDKCCRPNLVCSRTHKWCKYVF

SEQ ID NO: 27 - protein, 34 aa, Artificial Sequence
  Description of Artificial Sequence: Synthetic polypeptide
  C-term Amide
DCLGFMRKCIPDEDKCCRPNLVCSRTHKWCKYVF

SEQ ID NO: 28 - protein, 34 aa, Artificial Sequence
  Description of Artificial Sequence: Synthetic polypeptide
  C-term Amide
DCLGFMRKCIPDNDECCRPNLVCSRTHKWCKYVF

SEQ ID NO: 29 - protein, 34 aa, Artificial Sequence
  Description of Artificial Sequence: Synthetic polypeptide
  C-term Amide
DCLGFMRKCIPDNDKCCRPNLVCSRTEKWCKYVF

SEQ ID NO: 30 - protein, 34 aa, Artificial Sequence
  Description of Artificial Sequence: Synthetic polypeptide
  C-term Amide
DCLGFMRKCIPDNDKCCRPNLVCSRTHKECKYVF

SEQ ID NO: 31 - protein, 34 aa, Artificial Sequence
  Description of Artificial Sequence: Synthetic polypeptide
  C-term Amide
DCLGFMRKCIPDNDKCCRPNLVCSRTHKWCEYVF

SEQ ID NO: 32 - protein, 34 aa, Artificial Sequence
  Description of Artificial Sequence: Synthetic polypeptide
  C-term Amide
DCLGFMRKCIPDNDKCCRPNLVCSRTHKWCKEVF

SEQ ID NO: 33 - protein, 34 aa, Artificial Sequence
  Description of Artificial Sequence: Synthetic polypeptide
  C-term Amide
DCLGFMRKCIPDNDKCCRPNLVCSRTHKWCKYEF

SEQ ID NO: 34 - protein, 34 aa, Artificial Sequence
  Description of Artificial Sequence: Synthetic polypeptide
  C-term Amide
DCLGFMRKCIPDNDKCCRPNLVCSRTHKWCKYVE

SEQ ID NO: 35 - protein, 35 aa, Artificial Sequence
  Description of Artificial Sequence: Synthetic polypeptide
  C-term Amide
DCLGFMRKCIPDNDKCCRPNLVCSRTHKWCKYVFE

SEQ ID NO: 36 - protein, 35 aa, Artificial Sequence
  Description of Artificial Sequence: Synthetic polypeptide
  C-term Amide
KDCLGFMRKCIPDNDKCCRPNLVCSRTHKWCKYVF

SEQ ID NO: 37 - protein, 34 aa, Artificial Sequence
  Description of Artificial Sequence: Synthetic polypeptide
  C-term Amide
KCLGFMRKCIPDNDKCCRPNLVCSRTHKWCKYVF

SEQ ID NO: 38 - protein, 34 aa, Artificial Sequence
  Description of Artificial Sequence: Synthetic polypeptide
  C-term Amide
DCKGFMRKCIPDNDKCCRPNLVCSRTHKWCKYVF

SEQ ID NO: 39 - protein, 34 aa, Artificial Sequence
  Description of Artificial Sequence: Synthetic polypeptide
  C-term Amide
DCLKFMRKCIPDNDKCCRPNLVCSRTHKWCKYVF

SEQ ID NO: 40 - protein, 34 aa, Artificial Sequence
  Description of Artificial Sequence: Synthetic polypeptide
  C-term Amide
DCLGFMKKCIPDNDKCCRPNLVCSRTHKWCKYVF

SEQ ID NO: 41 - protein, 34 aa, Artificial Sequence
  Description of Artificial Sequence: Synthetic polypeptide
  C-term Amide
DCLGFMRKCKPDNDKCCRPNLVCSRTHKWCKYVF

SEQ ID NO: 42 - protein, 34 aa, Artificial Sequence
  Description of Artificial Sequence: Synthetic polypeptide
  C-term Amide
DCLGFMRKCIPKNDKCCRPNLVCSRTHKWCKYVF

SEQ ID NO: 43 - protein, 34 aa, Artificial Sequence
  Description of Artificial Sequence: Synthetic polypeptide
  C-term Amide
DCLGFMAKCIPDNDKCCRPNLVCSRTHKWCKYVF

SEQ ID NO: 44 - protein, 34 aa, Artificial Sequence
  Description of Artificial Sequence: Synthetic polypeptide
  C-term Amide
DCLGFMRACIPDNDKCCRPNLVCSRTHKWCKYVF

SEQ ID NO: 45 - protein, 34 aa, Artificial Sequence
  Description of Artificial Sequence: Synthetic polypeptide
  C-term Amide
DCLGFMRKCAPDNDKCCRPNLVCSRTHKWCKYVF

SEQ ID NO: 46 - protein, 34 aa, Artificial Sequence
  Description of Artificial Sequence: Synthetic polypeptide
  C-term Amide
DCLGFMRKCIADNDKCCRPNLVCSRTHKWCKYVF

SEQ ID NO: 47 - protein, 34 aa, Artificial Sequence
  Description of Artificial Sequence: Synthetic polypeptide
  C-term Amide
DCLGFMRKCIPDNDKCCRPNLVCSRTHKACKYVF

SEQ ID NO: 48 - protein, 34 aa, Artificial Sequence
  Description of Artificial Sequence: Synthetic polypeptide
  C-term Amide
DCLGFMRKCIPDKDKCCRPNLVCSRTHKWCKYVF

SEQ ID NO: 49 - protein, 34 aa, Artificial Sequence
  Description of Artificial Sequence: Synthetic polypeptide
  C-term Amide
DCLGFMRKCIPDNDKCCKPNLVCSRTHKWCKYVF

SEQ ID NO: 50 - protein, 34 aa, Artificial Sequence
  Description of Artificial Sequence: Synthetic polypeptide
  C-term Amide
DCLGFMRKCIPDNDKCCRKNLVCSRTHKWCKYVF

SEQ ID NO: 51 - protein, 34 aa, Artificial Sequence
  Description of Artificial Sequence: Synthetic polypeptide
  C-term Amide
DCLGFMRKCIPDNDKCCRPKLVCSRTHKWCKYVF

SEQ ID NO: 52 - protein, 34 aa, Artificial Sequence
  Description of Artificial Sequence: Synthetic polypeptide
  C-term Amide
DCLGFMRKCIPDNDKCCRPNLKCSRTHKWCKYVF

SEQ ID NO: 53 - protein, 34 aa, Artificial Sequence
  Description of Artificial Sequence: Synthetic polypeptide
  C-term Amide
DCLGFMRKCIPDNDKCCRPNLVCSKTHKWCKYVF

SEQ ID NO: 54 - protein, 34 aa, Artificial Sequence
  Description of Artificial Sequence: Synthetic polypeptide
  C-term Amide
DCLGFMRKCIPDNDKCCRPNLVCSRKHKWCKYVF

SEQ ID NO: 55 - protein, 34 aa, Artificial Sequence
  Description of Artificial Sequence: Synthetic polypeptide
  C-term Amide
DCLGFMRKCIPDNDKCCRPNLVCSRTKKWCKYVF

SEQ ID NO: 56 - protein, 34 aa, Artificial Sequence
  Description of Artificial Sequence: Synthetic polypeptide
  C-term Amide
DCLGFMRKCIPDNDKCCRPNLVCSRTHKKCKYVF

SEQ ID NO: 57 - protein, 34 aa, Artificial Sequence
  Description of Artificial Sequence: Synthetic polypeptide
  C-term Amide
DCLGFMRKCIPDNDKCCRPNLVCSRTHKWCKKVF

SEQ ID NO: 58 - protein, 34 aa, Artificial Sequence
  Description of Artificial Sequence: Synthetic polypeptide
  C-term Amide
DCLGFMRKCIPDNDKCCRPNLVCSRTHKWCKYKF

SEQ ID NO: 59 - protein, 34 aa, Artificial Sequence
  Description of Artificial Sequence: Synthetic polypeptide
  C-term Amide
DCLGFMRKCIPDNDKCCRPNLVCSRTHKWCKYVK

SEQ ID NO: 60 - protein, 35 aa, Artificial Sequence
  Description of Artificial Sequence: Synthetic polypeptide
  C-term Amide
DCLGFMRKCIPDNDKCCRPNLVCSRTHKWCKYVFK

SEQ ID NO: 61 - protein, 35 aa, Artificial Sequence
  Description of Artificial Sequence: Synthetic polypeptide
  C-term Amide
RDCLGFMRKCIPDNDKCCRPNLVCSRTHKWCKYVF

SEQ ID NO: 62 - protein, 34 aa, Artificial Sequence
  Description of Artificial Sequence: Synthetic polypeptide
  C-term Amide
RCLGFMRKCIPDNDKCCRPNLVCSRTHKWCKYVF

SEQ ID NO: 63 - protein, 34 aa, Artificial Sequence
  Description of Artificial Sequence: Synthetic polypeptide
  C-term Amide
DCLRFMRKCIPDNDKCCRPNLVCSRTHKWCKYVF

SEQ ID NO: 64 - protein, 34 aa, Artificial Sequence
  Description of Artificial Sequence: Synthetic polypeptide
  C-term Amide
DCLGFRRKCIPDNDKCCRPNLVCSRTHKWCKYVF

SEQ ID NO: 65 - protein, 34 aa, Artificial Sequence
  Description of Artificial Sequence: Synthetic polypeptide
  C-term Amide
DCLGFMRRCIPDNDKCCRPNLVCSRTHKWCKYVF

SEQ ID NO: 66 - protein, 34 aa, Artificial Sequence
  Description of Artificial Sequence: Synthetic polypeptide
  C-term Amide
DCLGFMRKCRPDNDKCCRPNLVCSRTHKWCKYVF

SEQ ID NO: 67 - protein, 34 aa, Artificial Sequence
  Description of Artificial Sequence: Synthetic polypeptide
  C-term Amide
DCLGFMRKCIPRNDKCCRPNLVCSRTHKWCKYVF

SEQ ID NO: 68 - protein, 34 aa, Artificial Sequence
  Description of Artificial Sequence: Synthetic polypeptide
  C-term Amide
DCLGFMRKCIPDNDRCCRPNLVCSRTHKWCKYVF

SEQ ID NO: 69 - protein, 34 aa, Artificial Sequence
  Description of Artificial Sequence: Synthetic polypeptide
  C-term Amide
DCLGFMRKCIPDNDKCCRPRLVCSRTHKWCKYVF

SEQ ID NO: 70 - protein, 34 aa, Artificial Sequence
  Description of Artificial Sequence: Synthetic polypeptide
  C-term Amide
DCLGFMRKCIPDNDKCCRPNLVCSRRHKWCKYVF

SEQ ID NO: 71 - protein, 34 aa, Artificial Sequence
  Description of Artificial Sequence: Synthetic polypeptide
  C-term Amide
DCLGFMRKCIPDNDKCCRPNLVCSRTRKWCKYVF

SEQ ID NO: 72 - protein, 34 aa, Artificial Sequence
  Description of Artificial Sequence: Synthetic polypeptide
  C-term Amide
DCLGFMRKCIPDNDKCCRPNLVCSRTHRWCKYVF

SEQ ID NO: 73 - protein, 34 aa, Artificial Sequence
  Description of Artificial Sequence: Synthetic polypeptide
  C-term Amide
DCLGFMRKCIPDNDKCCRPNLVCSRTHKWCRYVF

SEQ ID NO: 74 - protein, 34 aa, Artificial Sequence
  Description of Artificial Sequence: Synthetic polypeptide
  C-term Amide
DCLGFMRKCIPDNDKCCRPNLVCSRTHKWCKYRF

SEQ ID NO: 75 - protein, 34 aa, Artificial Sequence
  Description of Artificial Sequence: Synthetic polypeptide
  C-term Amide
DCLGFMRKCIPDNDKCCRPNLVCSRTHKWCKYVR

SEQ ID NO: 76 - protein, 35 aa, Artificial Sequence
  Description of Artificial Sequence: Synthetic polypeptide
  C-term Amide
DCLGFMRKCIPDNDKCCRPNLVCSRTHKWCKYVFR

SEQ ID NO: 77 - protein, 34 aa, Artificial Sequence
  Description of Artificial Sequence: Synthetic polypeptide
  MOD_RES (1)..(1): 1-Nal
  C-term Amide
XCLGFMRKCIPDNDKCCRPNLVCSRTHKWCKYVF

SEQ ID NO: 78 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKYVF

SEQ ID NO: 79 - protein, 34 aa, Artificial Sequence
  Description of Artificial Sequence: Synthetic polypeptide
  MOD_RES (29)..(29): 1-Nal
  C-term Amide
DCLGFMRKCIPDNDKCCRPNLVCSRTHKXCKYVF

SEQ ID NO: 80 - protein, 34 aa, Artificial Sequence
  Description of Artificial Sequence: Synthetic polypeptide
  MOD_RES (34)..(34): 1-Nal
  C-term Amide
DCLGFMRKCIPDNDKCCRPNLVCSRTHKWCKYVX

SEQ ID NO: 81 - protein, 34 aa, Artificial Sequence
  Description of Artificial Sequence: Synthetic polypeptide
  C-term Amide
WCLGFMRKCIPDNDKCCRPNLVCSRTHKWCKYVF

SEQ ID NO: 82 - protein, 34 aa, Artificial Sequence
  Description of Artificial Sequence: Synthetic polypeptide
  C-term Amide
DCLGWMRKCIPDNDKCCRPNLVCSRTHKWCKYVF

SEQ ID NO: 83 - protein, 34 aa, Artificial Sequence
  Description of Artificial Sequence: Synthetic polypeptide
  C-term Amide
DCLGFMRKCWPDNDKCCRPNLVCSRTHKWCKYVF

SEQ ID NO: 84 - protein, 34 aa, Artificial Sequence
  Description of Artificial Sequence: Synthetic polypeptide
  C-term Amide
DCLGFMRKCIPDNDKCCRPNLVCSRTWKWCKYVF

SEQ ID NO: 85 - protein, 34 aa, Artificial Sequence
  Description of Artificial Sequence: Synthetic polypeptide
  C-term Amide
DCLGFMRKCIPDNDKCCRPNLVCSRTHKWCKWVF

SEQ ID NO: 86 - protein, 34 aa, Artificial Sequence
  Description of Artificial Sequence: Synthetic polypeptide
  C-term Amide
DCLGFMRKCIPDNDKCCRPNLVCSRTHKWCKYVW

SEQ ID NO: 87 - protein, 35 aa, Artificial Sequence
  Description of Artificial Sequence: Synthetic polypeptide
  C-term Amide
DCLGFMRKCIPDNDKCCRPNLVCSRTHKWCKYVFW

SEQ ID NO: 88 - protein, 34 aa, Artificial Sequence
  Description of Artificial Sequence: Synthetic polypeptide
  C-term Amide
DCLGIMRKCIPDNDKCCRPNLVCSRTHKWCKYVF

SEQ ID NO: 89 - protein, 34 aa, Artificial Sequence
  Description of Artificial Sequence: Synthetic polypeptide
  C-term Amide
DCLGFFRKCIPDNDKCCRPNLVCSRTHKWCKYVF

SEQ ID NO: 90 - protein, 34 aa, Artificial Sequence
  Description of Artificial Sequence: Synthetic polypeptide
  C-term Amide
DCLGFMRKCNPDNDKCCRPNLVCSRTHKWCKYVF

SEQ ID NO: 91 - protein, 34 aa, Artificial Sequence
  Description of Artificial Sequence: Synthetic polypeptide
  C-term Amide
DCLGFMRKCIPSNDKCCRPNLVCSRTHKWCKYVF

SEQ ID NO: 92 - protein, 34 aa, Artificial Sequence
  Description of Artificial Sequence: Synthetic polypeptide
  C-term Amide
DCLGFMRKCIPDNDQCCRPNLVCSRTHKWCKYVF

SEQ ID NO: 93 - protein, 35 aa, Artificial Sequence
  Description of Artificial Sequence: Synthetic polypeptide
  C-term Amide
DCLGFMRKCIPDNDKCCRSSNLVCSRTHKWCKYVF

SEQ ID NO: 94 - protein, 34 aa, Artificial Sequence
  Description of Artificial Sequence: Synthetic polypeptide
  C-term Amide
DCLGFMRKCIPDNDKCCRPNLVCSRKTKWCKYVF

SEQ ID NO: 95 - protein, 34 aa, Artificial Sequence
  Description of Artificial Sequence: Synthetic polypeptide
  C-term Amide
DCLGFMRKCIPDNDKCCRPNLVCSRTHKWCKYQF

SEQ ID NO: 96 - protein, 34 aa, Artificial Sequence
  Description of Artificial Sequence: Synthetic polypeptide
  C-term Amide
DCLGFMRKCIPDNDKCCRPNLVCSRTHKWCKYVI

SEQ ID NO: 97 - protein, 34 aa, Artificial Sequence
  Description of Artificial Sequence: Synthetic polypeptide
  C-term Amide
YCLGFMRKCIPDNDKCCRPNLVCSRTHKWCKYVF

SEQ ID NO: 98 - protein, 34 aa, Artificial Sequence
  Description of Artificial Sequence: Synthetic polypeptide
  C-term Amide
DCQGFMRKCIPDNDKCCRPNLVCSRTHKWCKYVF

SEQ ID NO: 99 - protein, 35 aa, Artificial Sequence
  Description of Artificial Sequence: Synthetic polypeptide
  MOD_RES (34)..(34): 1-Nal
  C-term Amide
DCLGFMRKCIPDNDKCCRPNLVCSRTHKWCKKVXW

SEQ ID NO: 100 - protein, 35 aa, Artificial Sequence
  Description of Artificial Sequence: Synthetic polypeptide
  C-term Amide
ADCLGFMRKCIPDNDKCCRPNLVCSRTHKWCKYVF

SEQ ID NO: 101 - protein, 34 aa, Artificial Sequence
  Description of Artificial Sequence: Synthetic polypeptide
  C-term Amide
DCLGFMRKCIPDNDKCCRPNLVCSRTHKWCKYVA

SEQ ID NO: 102 - protein, 34 aa, Artificial Sequence
  Description of Artificial Sequence: Synthetic polypeptide
  C-term Amide
DCLGFMRKCIPDNDKCCRPNLECSRTHKWCKYVF

SEQ ID NO: 103 - protein, 34 aa, Artificial Sequence
  Description of Artificial Sequence: Synthetic polypeptide
  C-term Amide
DCLGFMRKCIPDRDKCCRPNLVCSRTHKWCKYVF

SEQ ID NO: 104 - protein, 34 aa, Artificial Sequence
  Description of Artificial Sequence: Synthetic polypeptide
  C-term Amide
DCLGFMRKCIPDNDKCCRPNLVCSRTHKRCKYVF

SEQ ID NO: 105 - protein, 34 aa, Artificial Sequence
  Description of Artificial Sequence: Synthetic polypeptide
  MOD_RES (5)..(5): 1-Nal
  C-term Amide
DCLGXMRKCIPDNDKCCRPNLVCSRTHKWCKYVF

SEQ ID NO: 106 - protein, 35 aa, Artificial Sequence
  Description of Artificial Sequence: Synthetic polypeptide
  C-term Amide
WDCLGFMRKCIPDNDKCCRPNLVCSRTHKWCKYVF

SEQ ID NO: 107 - protein, 34 aa, Artificial Sequence; identical to SEQ ID NO: 1
  Description of Artificial Sequence: Synthetic polypeptide
  C-term Free Acid

SEQ ID NO: 108 - protein, 33 aa, Artificial Sequence
  Description of Artificial Sequence: Synthetic polypeptide
  C-term Amide
CLGFMRKCIPDNDKCCRPNLVCSRTHKWCKYVF

SEQ ID NO: 109 - protein, 34 aa, Artificial Sequence
  Description of Artificial Sequence: Synthetic polypeptide
  C-term Amide
DCLGFMRKCIPDNDKCCRPNLVCSRTFKWCKYVF

SEQ ID NO: 110 - protein, 34 aa, Artificial Sequence
  Description of Artificial Sequence: Synthetic polypeptide
  C-term Amide
DCLGFMRKCIPDNDKCCRPNLVCSRTYKWCKYVF

SEQ ID NO: 111 - protein, 34 aa, Artificial Sequence
  Description of Artificial Sequence: Synthetic polypeptide
  C-term Amide
DCLGFMRKCIPDNDKCCRPNLVCSRTLKWCKYVF

SEQ ID NO: 112 - protein, 34 aa, Artificial Sequence
  Description of Artificial Sequence: Synthetic polypeptide
  C-term Amide
DCLGFMRKCIPDNDKCCRPNLVCSRTHKFCKYVF

SEQ ID NO: 113 - protein, 34 aa, Artificial Sequence
  Description of Artificial Sequence: Synthetic polypeptide
  C-term Amide
DCLGFMRKCIPDNDKCCRPNLVCSRTHKYCKYVF

SEQ ID NO: 114 - protein, 34 aa, Artificial Sequence
  Description of Artificial Sequence: Synthetic polypeptide
  C-term Amide
DCLGFMRKCIPDNDKCCRPNLVCSRTHKLCKYVF

SEQ ID NO: 115 - protein, 34 aa, Artificial Sequence
  Description of Artificial Sequence: Synthetic polypeptide
  MOD_RES (7)..(7): Cit
  C-term Amide
DCLGFMXKCIPDNDKCCRPNLVCSRTHKWCKYVF

SEQ ID NO: 116 - protein, 34 aa, Artificial Sequence
  Description of Artificial Sequence: Synthetic polypeptide
  MOD_RES (18)..(18): Cit
  C-term Amide
DCLGFMRKCIPDNDKCCXPNLVCSRTHKWCKYVF

SEQ ID NO: 117 - protein, 34 aa, Artificial Sequence
  Description of Artificial Sequence: Synthetic polypeptide
  MOD_RES (25)..(25): Cit
  C-term Amide
DCLGFMRKCIPDNDKCCRPNLVCSXTHKWCKYVF

SEQ ID NO: 118 - protein, 34 aa, Artificial Sequence
  Description of Artificial Sequence: Synthetic polypeptide
  C-term Amide
DCLGFMRTCIPDNDKCCRPNLVCSRTHKWCKYVF

SEQ ID NO: 119 - protein, 34 aa, Artificial Sequence
  Description of Artificial Sequence: Synthetic polypeptide
  C-term Amide
DCLGFMRKCDPDNDKCCRPNLVCSRTHKWCKYVF

SEQ ID NO: 120 - protein, 34 aa, Artificial Sequence
  Description of Artificial Sequence: Synthetic polypeptide
  C-term Amide
DCLGFMRKCIPDNDKCCRPNMVCSRTHKWCKYVF

SEQ ID NO: 121 - protein, 34 aa, Artificial Sequence
  Description of Artificial Sequence: Synthetic polypeptide
  C-term Amide
DCLGFMRKCIPDNDKCCRPNLVCSRLHKWCKYVF

SEQ ID NO: 122 - protein, 34 aa, Artificial Sequence
  Description of Artificial Sequence: Synthetic polypeptide
  C-term Amide
DCLGFMRKCIPDNDKCCRPNLVCSRTHKWCKYVL

SEQ ID NO: 123 - protein, 34 aa, Artificial Sequence; identical to SEQ ID NO: 3
  Description of Artificial Sequence: Synthetic polypeptide
  MOD_RES (6)..(6): Nle
  C-term Amide

SEQ ID NO: 124 - protein, 34 aa, Artificial Sequence; identical to SEQ ID NO: 3
  Description of Artificial Sequence: Synthetic polypeptide
  MOD_RES (6)..(6): 2-Abu
  C-term Amide

SEQ ID NO: 125 - protein, 34 aa, Artificial Sequence
  Description of Artificial Sequence: Synthetic polypeptide
  MOD_RES (2)..(2): 2-Abu
  MOD_RES (17)..(17): 2-Abu
  C-term Amide
DXLGFMRKCIPDNDKCXRPNLVCSRTHKWCKYVF

SEQ ID NO: 126 - protein, 34 aa, Artificial Sequence
  Description of Artificial Sequence: Synthetic polypeptide
  C-term Amide
DCLGFMRKCIPDNDKCCRGNLVCSRTHKWCKYVF

SEQ ID NO: 127 - protein, 35 aa, Artificial Sequence
  Description of Artificial Sequence: Synthetic polypeptide
  C-term Amide
DCLGFMRKCIPDNDKCCRPNLVCSRTHKWCKKVFW

SEQ ID NO: 128 - protein, 34 aa, Artificial Sequence; identical to SEQ ID NO: 105
  Description of Artificial Sequence: Synthetic polypeptide
  MOD_RES (5)..(5): 2-Nal
  C-term Amide

SEQ ID NO: 129 - protein, 34 aa, Artificial Sequence; identical to SEQ ID NO: 79
  Description of Artificial Sequence: Synthetic polypeptide
  MOD_RES (29)..(29): 2-Nal
  C-term Amide

SEQ ID NO: 130 - protein, 34 aa, Artificial Sequence; identical to SEQ ID NO: 80
  Description of Artificial Sequence: Synthetic polypeptide
  MOD_RES (34)..(34): 2-Nal
  C-term Amide

SEQ ID NO: 131 - protein, 35 aa, Artificial Sequence
  Description of Artificial Sequence: Synthetic polypeptide
  MOD_RES (35)..(35): 2-Nal
  C-term Amide
DCLGFMRKCIPDNDKCCRPNLVCSRTHKWCKYVFX

SEQ ID NO: 132 - protein, 34 aa, Artificial Sequence; identical to SEQ ID NO: 1
  Description of Artificial Sequence: Synthetic polypeptide
  N-term Acetyl
  C-term Amide

SEQ ID NO: 133 - protein, 35 aa, Artificial Sequence; identical to SEQ ID NO: 87
  Description of Artificial Sequence: Synthetic polypeptide
  C-term Free Acid

SEQ ID NO: 134 - protein, 33 aa, Artificial Sequence
  Description of Artificial Sequence: Synthetic polypeptide
  C-term Amide
DCLGFMRKCIPDNDKCCEGLVCSRTHKWCKYVF

SEQ ID NO: 135 - protein, 34 aa, Artificial Sequence
  Description of Artificial Sequence: Synthetic polypeptide
  MOD_RES (9)..(9): 2-Abu
  MOD_RES (23)..(23): 2-Abu
  C-term Amide
DCLGFMRKXIPDNDKCCRPNLVXSRTHKWCKYVF

SEQ ID NO: 136 - protein, 34 aa, Artificial Sequence
  Description of Artificial Sequence: Synthetic polypeptide
  MOD_RES (5)..(5): 2-Nal
  MOD_RES (34)..(34): 2-Nal
  C-term Amide
DCLGXMRKCIPDNDKCCRPNLVCSRTHKWCKYVX

SEQ ID NO: 137 - protein, 34 aa, Artificial Sequence; identical to SEQ ID NO: 136
  Description of Artificial Sequence: Synthetic polypeptide
  MOD_RES (5)..(5): 2-Nal
  MOD_RES (34)..(34): 1-Nal
  C-term Amide

SEQ ID NO: 138 - protein, 35 aa, Artificial Sequence
  Description of Artificial Sequence: Synthetic polypeptide
  MOD_RES (34)..(34): 1-Nal
  C-term Amide
DCLGFMRKCIPDNDKCCRPNLVCSRTHKWCKYVXW

SEQ ID NO: 139 - protein, 35 aa, Artificial Sequence; identical to SEQ ID NO: 138
  Description of Artificial Sequence: Synthetic polypeptide
  MOD_RES (34)..(34): 2-Nal
  C-term Amide

SEQ ID NO: 140 - protein, 34 aa, Artificial Sequence
  Description of Artificial Sequence: Synthetic polypeptide
  C-term Amide
DALGFMRKCIPDNDKCARPNLVCSRTHKWCKYVF

SEQ ID NO: 141 - protein, 34 aa, Artificial Sequence
  Description of Artificial Sequence: Synthetic polypeptide
  C-term Amide
DCLAFMRKCIPDNDKCCRPNLVCSRTHKWCKYVF

SEQ ID NO: 142 - protein, 34 aa, Artificial Sequence
  Description of Artificial Sequence: Synthetic polypeptide
  C-term Amide
DCLGFMRKCIPDNDKCCRPNLVCARTHKWCKYVF

SEQ ID NO: 143 - protein, 34 aa, Artificial Sequence
  Description of Artificial Sequence: Synthetic polypeptide
  C-term Amide
DCLGEMRKCIPDNDKCCRPNLVCSRTHKWCKYVF

SEQ ID NO: 144 - protein, 34 aa, Artificial Sequence
  Description of Artificial Sequence: Synthetic polypeptide
  C-term Amide
DCLGFERKCIPDNDKCCRPNLVCSRTHKWCKYVF

SEQ ID NO: 145 - protein, 34 aa, Artificial Sequence
  Description of Artificial Sequence: Synthetic polypeptide
  C-term Amide
DCLGFMEKCIPDNDKCCRPNLVCSRTHKWCKYVF

SEQ ID NO: 146 - protein, 34 aa, Artificial Sequence
  Description of Artificial Sequence: Synthetic polypeptide
  C-term Amide
DCLGFMRKCEPDNDKCCRPNLVCSRTHKWCKYVF

SEQ ID NO: 147 - protein, 34 aa, Artificial Sequence
  Description of Artificial Sequence: Synthetic polypeptide
  C-term Amide
DCLGFMRKCIEDNDKCCRPNLVCSRTHKWCKYVF

SEQ ID NO: 148 - protein, 34 aa, Artificial Sequence
  Description of Artificial Sequence: Synthetic polypeptide
  C-term Amide
DCLGFMRKCIPDNDKCCEPNLVCSRTHKWCKYVF

SEQ ID NO: 149 - protein, 34 aa, Artificial Sequence
  Description of Artificial Sequence: Synthetic polypeptide
  C-term Amide
DCLGFMRKCIPDNDKCCRPELVCSRTHKWCKYVF

SEQ ID NO: 150 - protein, 34 aa, Artificial Sequence
  Description of Artificial Sequence: Synthetic polypeptide
  C-term Amide
DCLGFMRKCIPDNDKCCRPNLVCERTHKWCKYVF

SEQ ID NO: 151 - protein, 34 aa, Artificial Sequence
  Description of Artificial Sequence: Synthetic polypeptide
  C-term Amide
DCLGFMRKCIPDNDKCCRPNLVCSETHKWCKYVF

SEQ ID NO: 152 - protein, 34 aa, Artificial Sequence
  Description of Artificial Sequence: Synthetic polypeptide
  C-term Amide
DCLGFMRKCIPDNDKCCRPNLVCSREHKWCKYVF

SEQ ID NO: 153 - protein, 34 aa, Artificial Sequence
  Description of Artificial Sequence: Synthetic polypeptide
  C-term Amide
DCLGFMRKCIPDNDKCCRPNLVCSRTHEWCKYVF

SEQ ID NO: 154 - protein, 34 aa, Artificial Sequence
  Description of Artificial Sequence: Synthetic polypeptide
  C-term Amide
DCLGFKRKCIPDNDKCCRPNLVCSRTHKWCKYVF

SEQ ID NO: 155 - protein, 34 aa, Artificial Sequence
  Description of Artificial Sequence: Synthetic polypeptide
  C-term Amide
DCRGFMRKCIPDNDKCCRPNLVCSRTHKWCKYVF

SEQ ID NO: 156 - protein, 34 aa, Artificial Sequence
  Description of Artificial Sequence: Synthetic polypeptide
  C-term Amide
DCLGRMRKCIPDNDKCCRPNLVCSRTHKWCKYVF

SEQ ID NO: 157 - protein, 34 aa, Artificial Sequence
  Description of Artificial Sequence: Synthetic polypeptide
  C-term Amide
DCLGFMRKCIPDNDKCCRRNLVCSRTHKWCKYVF

SEQ ID NO: 158 - protein, 34 aa, Artificial Sequence
  Description of Artificial Sequence: Synthetic polypeptide
  C-term Amide
DCLGFMRKCIPDNDKCCRPNLRCSRTHKWCKYVF

SEQ ID NO: 159 - protein, 34 aa, Artificial Sequence
  Description of Artificial Sequence: Synthetic polypeptide
  C-term Amide
DCLGFMRKCIPDNDKCCRPNLVCSRTHKWCKRVF

SEQ ID NO: 160 - protein, 34 aa, Artificial Sequence
  Description of Artificial Sequence: Synthetic polypeptide
  MOD_RES (4)..(4): 1-Nal
  C-term Amide
DCLXFMRKCIPDNDKCCRPNLVCSRTHKWCKYVF

SEQ ID NO: 161 - protein, 34 aa, Artificial Sequence; identical to SEQ ID NO: 3
  Description of Artificial Sequence: Synthetic polypeptide
  MOD_RES (6)..(6): 1-Nal
  C-term Amide

SEQ ID NO: 162 - protein, 34 aa, Artificial Sequence
  Description of Artificial Sequence: Synthetic polypeptide
  MOD_RES (12)..(12): 1-Nal
  C-term Amide
DCLGFMRKCIPXNDKCCRPNLVCSRTHKWCKYVF

SEQ ID NO: 163 - protein, 34 aa, Artificial Sequence
  Description of Artificial Sequence: Synthetic polypeptide
  MOD_RES (13)..(13): 1-Nal
  C-term Amide
DCLGFMRKCIPDXDKCCRPNLVCSRTHKWCKYVF

SEQ ID NO: 164 - protein, 34 aa, Artificial Sequence
  Description of Artificial Sequence: Synthetic polypeptide
  MOD_RES (20)..(20): 1-Nal
  C-term Amide
DCLGFMRKCIPDNDKCCRPXLVCSRTHKWCKYVF

SEQ ID NO: 165 - protein, 34 aa, Artificial Sequence
  Description of Artificial Sequence: Synthetic polypeptide
  MOD_RES (21)..(21): 1-Nal
  C-term Amide
DCLGFMRKCIPDNDKCCRPNXVCSRTHKWCKYVF

SEQ ID NO: 166 - protein, 34 aa, Artificial Sequence
  Description of Artificial Sequence: Synthetic polypeptide
  MOD_RES (27)..(27): 1-Nal
  C-term Amide
DCLGFMRKCIPDNDKCCRPNLVCSRTXKWCKYVF

SEQ ID NO: 167 - protein, 34 aa, Artificial Sequence
  Description of Artificial Sequence: Synthetic polypeptide
  MOD_RES (32)..(32): 1-Nal
  C-term Amide
DCLGFMRKCIPDNDKCCRPNLVCSRTHKWCKXVF

SEQ ID NO: 168 - protein, 34 aa, Artificial Sequence
  Description of Artificial Sequence: Synthetic polypeptide
  MOD_RES (33)..(33): 1-Nal
  C-term Amide
DCLGFMRKCIPDNDKCCRPNLVCSRTHKWCKYXF

SEQ ID NO: 169 - protein, 34 aa, Artificial Sequence
  Description of Artificial Sequence: Synthetic polypeptide
  C-term Amide
DCLWFMRKCIPDNDKCCRPNLVCSRTHKWCKYVF

SEQ ID NO: 170 - protein, 34 aa, Artificial Sequence
  Description of Artificial Sequence: Synthetic polypeptide
  C-term Amide
DCLGFWRKCIPDNDKCCRPNLVCSRTHKWCKYVF

SEQ ID NO: 171 - protein, 34 aa, Artificial Sequence
  Description of Artificial Sequence: Synthetic polypeptide
  C-term Amide
DCLGFMRKCIWDNDKCCRPNLVCSRTHKWCKYVF

SEQ ID NO: 172 - protein, 34 aa, Artificial Sequence
  Description of Artificial Sequence: Synthetic polypeptide
  C-term Amide
DCLGFMRKCIPWNDKCCRPNLVCSRTHKWCKYVF

SEQ ID NO: 173 - protein, 34 aa, Artificial Sequence
  Description of Artificial Sequence: Synthetic polypeptide
  C-term Amide
DCLGFMRKCIPDWDKCCRPNLVCSRTHKWCKYVF

SEQ ID NO: 174 - protein, 34 aa, Artificial Sequence
  Description of Artificial Sequence: Synthetic polypeptide
  C-term Amide
DCLGFMRKCIPDNDKCCWPNLVCSRTHKWCKYVF

SEQ ID NO: 175 - protein, 34 aa, Artificial Sequence
  Description of Artificial Sequence: Synthetic polypeptide
  C-term Amide
DCLGFMRKCIPDNDKCCRPWLVCSRTHKWCKYVF

SEQ ID NO: 176 - protein, 34 aa, Artificial Sequence
  Description of Artificial Sequence: Synthetic polypeptide
  C-term Amide
DCLGFMRKCIPDNDKCCRPNWVCSRTHKWCKYVF

SEQ ID NO: 177 - protein, 34 aa, Artificial Sequence
  Description of Artificial Sequence: Synthetic polypeptide
  C-term Amide
DCLGFMRKCIPDNDKCCRPNLWCSRTHKWCKYVF

SEQ ID NO: 178 - protein, 34 aa, Artificial Sequence
  Description of Artificial Sequence: Synthetic polypeptide
  C-term Amide
DCLGFMRKCIPDNDKCCRPNLVCSRWHKWCKYVF

SEQ ID NO: 179 - protein, 34 aa, Artificial Sequence
  Description of Artificial Sequence: Synthetic polypeptide
  C-term Amide
DCLGFMRKCIPDNDKCCRPNLVCSRTHKWCWYVF

SEQ ID NO: 180 - protein, 34 aa, Artificial Sequence
  Description of Artificial Sequence: Synthetic polypeptide
  C-term Amide
DCLGFMRKCIPDNDKCCRPNLVCSRTHKWCKYWF

SEQ ID NO: 181 - protein, 34 aa, Artificial Sequence
  Description of Artificial Sequence: Synthetic polypeptide
  C-term Amide
DCLGFMRKCIPDNDKCCRSNLVCSRTHKWCKYVF

SEQ ID NO: 182 - protein, 34 aa, Artificial Sequence
  Description of Artificial Sequence: Synthetic polypeptide
  MOD_RES (34)..(34): 1-Nal
  C-term Amide
DCLGFMRKCIPDNDKCCRPNLVCSRTHKWCKYQX

SEQ ID NO: 183 - protein, 34 aa, Artificial Sequence
  Description of Artificial Sequence: Synthetic polypeptide
  MOD_RES (34)..(34): 1-Nal
  C-term Amide
DCLGFMRKCIPDNDKCCRPNLVCSRTHRWCKYQX

SEQ ID NO: 184 - protein, 34 aa, Artificial Sequence
  Description of Artificial Sequence: Synthetic polypeptide
  MOD_RES (34)..(34): 1-Nal
  C-term Amide
DCLGFMRKCIPDNDKCCRPRLVCSRTHKWCKYQX

SEQ ID NO: 185 - protein, 34 aa, Artificial Sequence
  Description of Artificial Sequence: Synthetic polypeptide
  MOD_RES (34)..(34): 1-Nal
  C-term Amide
DCLGFMRKCIPDNDKCCRPRLVCSRTHRWCKYQX

SEQ ID NO: 186 - protein, 34 aa, Artificial Sequence
  Description of Artificial Sequence: Synthetic polypeptide
  MOD_RES (34)..(34): 1-Nal
  C-term Amide
DCLGFMRKCIPDNDRCCRPNLVCSRTHKWCKYQX

SEQ ID NO: 187 - protein, 36 aa, Artificial Sequence
  Description of Artificial Sequence: Synthetic polypeptide
  C-term Amide
RDCLGFMRKCIPDNDKCCRPNLVCSRTHKWCKYVFW

SEQ ID NO: 188 - protein, 34 aa, Artificial Sequence; identical to SEQ ID NO: 77
  Description of Artificial Sequence: Synthetic polypeptide
  MOD_RES (1)..(1): pGlu
  C-term Amide

SEQ ID NO: 189 - protein, 34 aa, Artificial Sequence
  Description of Artificial Sequence: Synthetic polypeptide
  C-term Amide
ICLGFMRKCIPDNDKCCRPNLVCSRTHKWCKYVF

SEQ ID NO: 190 - protein, 34 aa, Artificial Sequence
  Description of Artificial Sequence: Synthetic polypeptide
  C-term Amide
PCLGFMRKCIPDNDKCCRPNLVCSRTHKWCKYVF

SEQ ID NO: 191 - protein, 34 aa, Artificial Sequence
  Description of Artificial Sequence: Synthetic polypeptide
  C-term Amide
SCLGFMRKCIPDNDKCCRPNLVCSRTHKWCKYVF

SEQ ID NO: 192 - protein, 34 aa, Artificial Sequence
  Description of Artificial Sequence: Synthetic polypeptide
  C-term Amide
TCLGFMRKCIPDNDKCCRPNLVCSRTHKWCKYVF

SEQ ID NO: 193 - protein, 34 aa, Artificial Sequence
  Description of Artificial Sequence: Synthetic polypeptide
  C-term Amide
DCLGFMRKCIPLNDKCCRPNLVCSRTHKWCKYVF

SEQ ID NO: 194 - protein, 34 aa, Artificial Sequence
  Description of Artificial Sequence: Synthetic polypeptide
  C-term Amide
DCLGFMRKCIPGNDKCCRPNLVCSRTHKWCKYVF

SEQ ID NO: 195 - protein, 34 aa, Artificial Sequence
  Description of Artificial Sequence: Synthetic polypeptide
  C-term Amide
DCLGFMRKCIPINDKCCRPNLVCSRTHKWCKYVF

SEQ ID NO: 196 - protein, 34 aa, Artificial Sequence
  Description of Artificial Sequence: Synthetic polypeptide
  C-term Amide
DCLGFMRKCIPTNDKCCRPNLVCSRTHKWCKYVF

SEQ ID NO: 197 - protein, 34 aa, Artificial Sequence
  Description of Artificial Sequence: Synthetic polypeptide
  C-term Amide
DCLGFMRKCIPYNDKCCRPNLVCSRTHKWCKYVF

SEQ ID NO: 198 - protein, 34 aa, Artificial Sequence
  Description of Artificial Sequence: Synthetic polypeptide
  C-term Amide
DCLGFMRKCIPDNDKCCRPGLVCSRTHKWCKYVF

SEQ ID NO: 199 - protein, 34 aa, Artificial Sequence
  Description of Artificial Sequence: Synthetic polypeptide
  C-term Amide
DCLGFMRKCIPDNDKCCRPFLVCSRTHKWCKYVF

SEQ ID NO: 200 - protein, 34 aa, Artificial Sequence
  Description of Artificial Sequence: Synthetic polypeptide
  C-term Amide
DCLGFMRKCIPDNDKCCRPYLVCSRTHKWCKYVF

SEQ ID NO: 201 - protein, 35 aa, Artificial Sequence
  Description of Artificial Sequence: Synthetic polypeptide
  MOD_RES (1)..(1): 1-Nal
  C-term Amide
XDCLGFMRKCIPDNDKCCRPNLVCSRTHKWCKYVF

SEQ ID NO: 202 - protein, 34 aa, Artificial Sequence
  Description of Artificial Sequence: Synthetic polypeptide
  C-term Amide
DCWGFMRKCIPDNDKCCRPNLVCSRTHKWCKYVF

SEQ ID NO: 203 - protein, 34 aa, Artificial Sequence
  Description of Artificial Sequence: Synthetic polypeptide
  MOD_RES (3)..(3): 1-Nal
  C-term Amide
DCXGFMRKCIPDNDKCCRPNLVCSRTHKWCKYVF

SEQ ID NO: 204 - protein, 34 aa, Artificial Sequence
  Description of Artificial Sequence: Synthetic polypeptide
  C-term Amide
DCLGKMRKCIPDNDKCCRPNLVCSRTHKWCKYVF

SEQ ID NO: 205 - protein, 34 aa, Artificial Sequence
  Description of Artificial Sequence: Synthetic polypeptide
  C-term Amide
DCLGFMWKCIPDNDKCCRPNLVCSRTHKWCKYVF

SEQ ID NO: 206 - protein, 34 aa, Artificial Sequence; identical to SEQ ID NO: 115
  Description of Artificial Sequence: Synthetic polypeptide
  MOD_RES (7)..(7): 1-Nal
  C-term Amide

SEQ ID NO: 207 - protein, 34 aa, Artificial Sequence
  Description of Artificial Sequence: Synthetic polypeptide
  C-term Amide
DCLGFMRWCIPDNDKCCRPNLVCSRTHKWCKYVF

SEQ ID NO: 208 - protein, 34 aa, Artificial Sequence
  Description of Artificial Sequence: Synthetic polypeptide
  MOD_RES (8)..(8): 1-Nal
  C-term Amide
DCLGFMRXCIPDNDKCCRPNLVCSRTHKWCKYVF

SEQ ID NO: 209 - protein, 34 aa, Artificial Sequence
  Description of Artificial Sequence: Synthetic polypeptide
  C-term Amide
DCLGFMRKCIKDNDKCCRPNLVCSRTHKWCKYVF

SEQ ID NO: 210 - protein, 34 aa, Artificial Sequence
  Description of Artificial Sequence: Synthetic polypeptide
  C-term Amide
DCLGFMRKCIRDNDKCCRPNLVCSRTHKWCKYVF

SEQ ID NO: 211 - protein, 34 aa, Artificial Sequence
  Description of Artificial Sequence: Synthetic polypeptide
  MOD_RES (11)..(11): 1-Nal
  C-term Amide
DCLGFMRKCIXDNDKCCRPNLVCSRTHKWCKYVF

SEQ ID NO: 212 - protein, 34 aa, Artificial Sequence
  Description of Artificial Sequence: Synthetic polypeptide
  C-term Amide
DCLGFMRKCIPDNAKCCRPNLVCSRTHKWCKYVF

SEQ ID NO: 213 - protein, 34 aa, Artificial Sequence
  Description of Artificial Sequence: Synthetic polypeptide
  C-term Amide
DCLGFMRKCIPDNEKCCRPNLVCSRTHKWCKYVF

SEQ ID NO: 214 - protein, 34 aa, Artificial Sequence
  Description of Artificial Sequence: Synthetic polypeptide
  C-term Amide
DCLGFMRKCIPDNKKCCRPNLVCSRTHKWCKYVF

SEQ ID NO: 215 - protein, 34 aa, Artificial Sequence
  Description of Artificial Sequence: Synthetic polypeptide
  C-term Amide
DCLGFMRKCIPDNRKCCRPNLVCSRTHKWCKYVF

SEQ ID NO: 216 - protein, 34 aa, Artificial Sequence
  Description of Artificial Sequence: Synthetic polypeptide
  C-term Amide
DCLGFMRKCIPDNWKCCRPNLVCSRTHKWCKYVF

SEQ ID NO: 217 - protein, 34 aa, Artificial Sequence
  Description of Artificial Sequence: Synthetic polypeptide
  MOD_RES (14)..(14): 1-Nal
  C-term Amide
DCLGFMRKCIPDNXKCCRPNLVCSRTHKWCKYVF

SEQ ID NO: 218 - protein, 34 aa, Artificial Sequence
  Description of Artificial Sequence: Synthetic polypeptide
  C-term Amide
DCLGFMRKCIPDNDWCCRPNLVCSRTHKWCKYVF

SEQ ID NO: 219 - protein, 34 aa, Artificial Sequence
  Description of Artificial Sequence: Synthetic polypeptide
  MOD_RES (15)..(15): 1-Nal
  C-term Amide
DCLGFMRKCIPDNDXCCRPNLVCSRTHKWCKYVF

SEQ ID NO: 220 - protein, 34 aa, Artificial Sequence
  Description of Artificial Sequence: Synthetic polypeptide
  C-term Amide
DCLGFMRKCIPDNDKCCAPNLVCSRTHKWCKYVF

SEQ ID NO: 221 - protein, 34 aa, Artificial Sequence; identical to SEQ ID NO: 116
  Description of Artificial Sequence: Synthetic polypeptide
  MOD_RES (18)..(18): 1-Nal
  C-term Amide

SEQ ID NO: 222 - protein, 34 aa, Artificial Sequence
  Description of Artificial Sequence: Synthetic polypeptide
  C-term Amide
DCLGFMRKCIPDNDKCCRANLVCSRTHKWCKYVF

SEQ ID NO: 223 - protein, 34 aa, Artificial Sequence
  Description of Artificial Sequence: Synthetic polypeptide
  C-term Amide
DCLGFMRKCIPDNDKCCRENLVCSRTHKWCKYVF

SEQ ID NO: 224 - protein, 34 aa, Artificial Sequence
  Description of Artificial Sequence: Synthetic polypeptide
  C-term Amide
DCLGFMRKCIPDNDKCCRWNLVCSRTHKWCKYVF

SEQ ID NO: 225 - protein, 34 aa, Artificial Sequence
  Description of Artificial Sequence: Synthetic polypeptide
  MOD_RES (19)..(19): 1-Nal
  C-term Amide
DCLGFMRKCIPDNDKCCRXNLVCSRTHKWCKYVF

SEQ ID NO: 226 - protein, 34 aa, Artificial Sequence
  Description of Artificial Sequence: Synthetic polypeptide
  C-term Amide
DCLGFMRKCIPDNDKCCRPNAVCSRTHKWCKYVF

SEQ ID NO: 227 - protein, 34 aa, Artificial Sequence
  Description of Artificial Sequence: Synthetic polypeptide
  C-term Amide
DCLGFMRKCIPDNDKCCRPNEVCSRTHKWCKYVF

SEQ ID NO: 228 - protein, 34 aa, Artificial Sequence
  Description of Artificial Sequence: Synthetic polypeptide
  C-term Amide
DCLGFMRKCIPDNDKCCRPNKVCSRTHKWCKYVF

SEQ ID NO: 229 - protein, 34 aa, Artificial Sequence
  Description of Artificial Sequence: Synthetic polypeptide
  C-term Amide
DCLGFMRKCIPDNDKCCRPNRVCSRTHKWCKYVF

SEQ ID NO: 230 - protein, 34 aa, Artificial Sequence
  Description of Artificial Sequence: Synthetic polypeptide
  MOD_RES (22)..(22): 1-Nal
  C-term Amide
DCLGFMRKCIPDNDKCCRPNLXCSRTHKWCKYVF

SEQ ID NO: 231 - protein, 34 aa, Artificial Sequence
  Description of Artificial Sequence: Synthetic polypeptide
  C-term Amide
DCLGFMRKCIPDNDKCCRPNLVCKRTHKWCKYVF

SEQ ID NO: 232 - protein, 34 aa, Artificial Sequence
  Description of Artificial Sequence: Synthetic polypeptide
  C-term Amide
DCLGFMRKCIPDNDKCCRPNLVCRRTHKWCKYVF

SEQ ID NO: 233 - protein, 34 aa, Artificial Sequence
  Description of Artificial Sequence: Synthetic polypeptide
  C-term Amide
DCLGFMRKCIPDNDKCCRPNLVCWRTHKWCKYVF

SEQ ID NO: 234 - protein, 34 aa, Artificial Sequence
  Description of Artificial Sequence: Synthetic polypeptide
  MOD_RES (24)..(24): 1-Nal
  C-term Amide
DCLGFMRKCIPDNDKCCRPNLVCXRTHKWCKYVF

SEQ ID NO: 235 - protein, 34 aa, Artificial Sequence
  Description of Artificial Sequence: Synthetic polypeptide
  C-term Amide
DCLGFMRKCIPDNDKCCRPNLVCSWTHKWCKYVF

SEQ ID NO: 236 - protein, 34 aa, Artificial Sequence; identical to SEQ ID NO: 117
  Description of Artificial Sequence: Synthetic polypeptide
  MOD_RES (25)..(25): 1-Nal
  C-term Amide

SEQ ID NO: 237 - protein, 34 aa, Artificial Sequence
  Description of Artificial Sequence: Synthetic polypeptide
  MOD_RES (26)..(26): 1-Nal
  C-term Amide
DCLGFMRKCIPDNDKCCRPNLVCSRXHKWCKYVF

SEQ ID NO: 238 - protein, 34 aa, Artificial Sequence
  Description of Artificial Sequence: Synthetic polypeptide
  C-term Amide
DCLGFMRKCIPDNDKCCRPNLVCSRTHWWCKYVF

SEQ ID NO: 239 - protein, 34 aa, Artificial Sequence
  Description of Artificial Sequence: Synthetic polypeptide
  MOD_RES (28)..(28): 1-Nal
  C-term Amide
DCLGFMRKCIPDNDKCCRPNLVCSRTHXWCKYVF

SEQ ID NO: 240 - protein, 34 aa, Artificial Sequence
  Description of Artificial Sequence: Synthetic polypeptide
  MOD_RES (31)..(31): 1-Nal
  C-term Amide
DCLGFMRKCIPDNDKCCRPNLVCSRTHKWCXYVF

SEQ ID NO: 241 - protein, 35 aa, Artificial Sequence; identical to SEQ ID NO: 131
  Description of Artificial Sequence: Synthetic polypeptide
  MOD_RES (35)..(35): 1Nal
  C-term Amide

SEQ ID NO: 242 - protein, 34 aa, Artificial Sequence; identical to SEQ ID NO: 105
  Description of Artificial Sequence: Synthetic polypeptide
  MOD_RES (5)..(5): Bip
  C-term Amide

SEQ ID NO: 243 - protein, 34 aa, Artificial Sequence; identical to SEQ ID NO: 105
  Description of Artificial Sequence: Synthetic polypeptide
  MOD_RES (5)..(5): Cha
  C-term Amide

SEQ ID NO: 244 - protein, 34 aa, Artificial Sequence
  Description of Artificial Sequence: Synthetic polypeptide
  C-term Amide
DCLGFLRKCIPDNDKCCRPNLVCSRTHKWCKYVF

SEQ ID NO: 245 - protein, 34 aa, Artificial Sequence; identical to SEQ ID NO: 3
  Description of Artificial Sequence: Synthetic polypeptide
  MOD_RES (6)..(6): Cha
  C-term Amide

SEQ ID NO: 246 - protein, 34 aa, Artificial Sequence; identical to SEQ ID NO: 167
  Description of Artificial Sequence: Synthetic polypeptide
  MOD_RES (32)..(32): 1'NMeTrp
  C-term Amide

SEQ ID NO: 247 - protein, 34 aa, Artificial Sequence; identical to SEQ ID NO: 105
  Description of Artificial Sequence: Synthetic polypeptide
  MOD_RES (5)..(5): pI-Phe
  C-term Amide

SEQ ID NO: 248 - protein, 34 aa, Artificial Sequence
  Description of Artificial Sequence: Synthetic polypeptide
  C-term Amide
DCLGFMRKCIPDNDKCCRPNLVCSRTHKWCKYIF

SEQ ID NO: 249 - protein, 34 aa, Artificial Sequence; identical to SEQ ID NO: 168
  Description of Artificial Sequence: Synthetic polypeptide
  MOD_RES (33)..(33): pI-Phe
  C-term Amide

SEQ ID NO: 250 - protein, 34 aa, Artificial Sequence; identical to SEQ ID NO: 168
  Description of Artificial Sequence: Synthetic polypeptide
  MOD_RES (33)..(33): 1'NMeTrp
  C-term Amide

SEQ ID NO: 251 - protein, 34 aa, Artificial Sequence
  Description of Artificial Sequence: Synthetic polypeptide
  MOD_RES (32)..(32): 1-Nal
  C-term Amide
DCLGFMRKCIPDNDKCCRPNLVCSRTHRWCKXVF

SEQ ID NO: 252 - protein, 34 aa, Artificial Sequence
  Description of Artificial Sequence: Synthetic polypeptide
  C-term Amide
DCLGAMRKCIPDNDKCCRPNLVCSRTHKWCKYWF

SEQ ID NO: 253 - protein, 34 aa, Artificial Sequence
  Description of Artificial Sequence: Synthetic polypeptide
  C-term Amide
DCLGAMRKCIPDNDKCCRPNLVCSRTHKWCKWVF

SEQ ID NO: 254 - protein, 34 aa, Artificial Sequence
  Description of Artificial Sequence: Synthetic polypeptide
  MOD_RES (32)..(32): 1-Nal
  C-term Amide
DCLGAMRKCIPDNDKCCRPNLVCSRTHKWCKXVF

SEQ ID NO: 255 - protein, 34 aa, Artificial Sequence
  Description of Artificial Sequence: Synthetic polypeptide
  C-term Amide
DCLGAMRKCIPDNDKCCRPNLVCSRLHKWCKYVF

SEQ ID NO: 256 - protein, 34 aa, Artificial Sequence
  Description of Artificial Sequence: Synthetic polypeptide
  MOD_RES (6)..(6): 1-Nal
  C-term Amide
DCLGAXRKCIPDNDKCCRPNLVCSRTHKWCKYVF

SEQ ID NO: 257 - protein, 34 aa, Artificial Sequence
  Description of Artificial Sequence: Synthetic polypeptide
  C-term Amide
DCLGAFRKCIPDNDKCCRPNLVCSRTHKWCKYVF

SEQ ID NO: 258 - protein, 34 aa, Artificial Sequence
  Description of Artificial Sequence: Synthetic polypeptide
  MOD_RES (33)..(33): 1-Nal
  C-term Amide
DCLGAMRKCIPDNDKCCRPNLVCSRTHKWCKYXF

SEQ ID NO: 259 - protein, 34 aa, Artificial Sequence
  Description of Artificial Sequence: Synthetic polypeptide
  MOD_RES (10)..(10): 1-Nal
  C-term Amide
DCLGAMRKCXPDNDKCCRPNLVCSRTHKWCKYVF

SEQ ID NO: 260 - protein, 34 aa, Artificial Sequence
  Description of Artificial Sequence: Synthetic polypeptide
  C-term Amide
DCLGAMRKCIPDNDKCCRPNLVCSRTHRWCKYVF

SEQ ID NO: 261 - protein, 34 aa, Artificial Sequence
  Description of Artificial Sequence: Synthetic polypeptide
  C-term Amide
DCLGAWRKCIPDNDKCCRPNLVCSRTHKWCKYVF

SEQ ID NO: 262 - protein, 34 aa, Artificial Sequence
  Description of Artificial Sequence: Synthetic polypeptide
  C-term Amide
DCLGAFRKCIPDNDKCCRPNLVCSRLHRWCKYVF

SEQ ID NO: 263 - protein, 34 aa, Artificial Sequence
  Description of Artificial Sequence: Synthetic polypeptide
  C-term Amide
DCLGAFRKCIPDNDKCCRPNLVCSRLHKWCKYVF

SEQ ID NO: 264 - protein, 34 aa, Artificial Sequence; identical to SEQ ID NO: 105
  Description of Artificial Sequence: Synthetic polypeptide
  MOD_RES (5)..(5): 1'NMeTrp
  C-term Amide

SEQ ID NO: 265 - protein, 34 aa, Artificial Sequence
  Description of Artificial Sequence: Synthetic polypeptide
  C-term Amide
DCLGGMRKCIPDNDKCCRPNLVCSRTHKWCKYVF

SEQ ID NO: 266 - protein, 34 aa, Artificial Sequence
  Description of Artificial Sequence: Synthetic polypeptide
  C-term Amide
DCLGHMRKCIPDNDKCCRPNLVCSRTHKWCKYVF

SEQ ID NO: 267 - protein, 34 aa, Artificial Sequence
  Description of Artificial Sequence: Synthetic polypeptide
  C-term Amide
DCLGLMRKCIPDNDKCCRPNLVCSRTHKWCKYVF

SEQ ID NO: 268 - protein, 34 aa, Artificial Sequence
  Description of Artificial Sequence: Synthetic polypeptide
  C-term Amide
DCLGMMRKCIPDNDKCCRPNLVCSRTHKWCKYVF

SEQ ID NO: 269 - protein, 34 aa, Artificial Sequence
  Description of Artificial Sequence: Synthetic polypeptide
  C-term Amide
DCLGPMRKCIPDNDKCCRPNLVCSRTHKWCKYVF

SEQ ID NO: 270 - protein, 34 aa, Artificial Sequence
  Description of Artificial Sequence: Synthetic polypeptide
  C-term Amide
DCLGTMRKCIPDNDKCCRPNLVCSRTHKWCKYVF

SEQ ID NO: 271 - protein, 34 aa, Artificial Sequence
  Description of Artificial Sequence: Synthetic polypeptide
  C-term Amide
DCLGYMRKCIPDNDKCCRPNLVCSRTHKWCKYVF

SEQ ID NO: 272 - protein, 34 aa, Artificial Sequence
  Description of Artificial Sequence: Synthetic polypeptide
  C-term Amide
DCLGVMRKCIPDNDKCCRPNLVCSRTHKWCKYVF

SEQ ID NO: 273 - protein, 34 aa, Artificial Sequence; identical to SEQ ID NO: 1
  Description of Artificial Sequence: Synthetic polypeptide
  MOD_RES (5)..(5): D-amino acid
  C-term Amide

SEQ ID NO: 274 - protein, 34 aa, Artificial Sequence; identical to SEQ ID NO: 105
  Description of Artificial Sequence: Synthetic polypeptide
  MOD_RES (5)..(5): NMeTrp
  C-term Amide

SEQ ID NO: 275 - protein, 34 aa, Artificial Sequence; identical to SEQ ID NO: 105
  Description of Artificial Sequence: Synthetic polypeptide
  MOD_RES (5)..(5): Phg
  C-term Amide

SEQ ID NO: 276 - protein, 34 aa, Artificial Sequence; identical to SEQ ID NO: 105
  Description of Artificial Sequence: Synthetic polypeptide
  MOD_RES (5)..(5): 4CO2-Phe
  C-term Amide

SEQ ID NO: 277 - protein, 34 aa, Artificial Sequence; identical to SEQ ID NO: 105
  Description of Artificial Sequence: Synthetic polypeptide
  MOD_RES (5)..(5): 2PAL
  C-term Amide

SEQ ID NO: 278 - protein, 34 aa, Artificial Sequence
  Description of Artificial Sequence: Synthetic polypeptide
  C-term Amide
DCLGFNRKCIPDNDKCCRPNLVCSRTHKWCKYVF

SEQ ID NO: 279 - protein, 34 aa, Artificial Sequence
  Description of Artificial Sequence: Synthetic polypeptide
  C-term Amide
DCLGFQRKCIPDNDKCCRPNLVCSRTHKWCKYVF

SEQ ID NO: 280 - protein, 34 aa, Artificial Sequence
  Description of Artificial Sequence: Synthetic polypeptide
  C-term Amide
DCLGFGRKCIPDNDKCCRPNLVCSRTHKWCKYVF

SEQ ID NO: 281 - protein, 34 aa, Artificial Sequence
  Description of Artificial Sequence: Synthetic polypeptide
  C-term Amide
DCLGFHRKCIPDNDKCCRPNLVCSRTHKWCKYVF

SEQ ID NO: 282 - protein, 34 aa, Artificial Sequence
  Description of Artificial Sequence: Synthetic polypeptide
  C-term Amide
DCLGFIRKCIPDNDKCCRPNLVCSRTHKWCKYVF

SEQ ID NO: 283 - protein, 34 aa, Artificial Sequence
  Description of Artificial Sequence: Synthetic polypeptide
  C-term Amide
DCLGFPRKCIPDNDKCCRPNLVCSRTHKWCKYVF

SEQ ID NO: 284 - protein, 34 aa, Artificial Sequence
  Description of Artificial Sequence: Synthetic polypeptide
  C-term Amide
DCLGFSRKCIPDNDKCCRPNLVCSRTHKWCKYVF

SEQ ID NO: 285 - protein, 34 aa, Artificial Sequence
  Description of Artificial Sequence: Synthetic polypeptide
  C-term Amide
DCLGFTRKCIPDNDKCCRPNLVCSRTHKWCKYVF

SEQ ID NO: 286 - protein, 34 aa, Artificial Sequence
  Description of Artificial Sequence: Synthetic polypeptide
  C-term Amide
DCLGFYRKCIPDNDKCCRPNLVCSRTHKWCKYVF

SEQ ID NO: 287 - protein, 34 aa, Artificial Sequence
  Description of Artificial Sequence: Synthetic polypeptide
  C-term Amide
DCLGFVRKCIPDNDKCCRPNLVCSRTHKWCKYVF

SEQ ID NO: 288 - protein, 34 aa, Artificial Sequence; identical to SEQ ID NO: 3
  Description of Artificial Sequence: Synthetic polypeptide
  MOD_RES (6)..(6): Phg
  C-term Amide

SEQ ID NO: 289 - protein, 34 aa, Artificial Sequence; identical to SEQ ID NO: 3
  Description of Artificial Sequence: Synthetic polypeptide
  MOD_RES (6)..(6): NMeTrp
  C-term Amide

SEQ ID NO: 290 - protein, 34 aa, Artificial Sequence; identical to SEQ ID NO: 3
  Description of Artificial Sequence: Synthetic polypeptide
  MOD_RES (6)..(6): NMePhe
  C-term Amide

SEQ ID NO: 291 - protein, 34 aa, Artificial Sequence; identical to SEQ ID NO: 3
  Description of Artificial Sequence: Synthetic polypeptide
  MOD_RES (6)..(6): pI-Phe
  C-term Amide

SEQ ID NO: 292 - protein, 34 aa, Artificial Sequence; identical to SEQ ID NO: 3
  Description of Artificial Sequence: Synthetic polypeptide
  MOD_RES (6)..(6): 1'NMeTrp
  C-term Amide

SEQ ID NO: 293 - protein, 34 aa, Artificial Sequence; identical to SEQ ID NO: 3
  Description of Artificial Sequence: Synthetic polypeptide
  MOD_RES (6)..(6): 4CO2-Phe
  C-term Amide

SEQ ID NO: 294 - protein, 34 aa, Artificial Sequence; identical to SEQ ID NO: 3
  Description of Artificial Sequence: Synthetic polypeptide
  MOD_RES (6)..(6): 2PAL
  C-term Amide

SEQ ID NO: 295 - protein, 34 aa, Artificial Sequence; identical to SEQ ID NO: 115
  Description of Artificial Sequence: Synthetic polypeptide
  MOD_RES (7)..(7): Lys(Me2)
  C-term Amide

SEQ ID NO: 296 - protein, 34 aa, Artificial Sequence; identical to SEQ ID NO: 115
  Description of Artificial Sequence: Synthetic polypeptide
  MOD_RES (7)..(7): SDMArg
  C-term Amide

SEQ ID NO: 297 - protein, 34 aa, Artificial Sequence; identical to SEQ ID NO: 208
  Description of Artificial Sequence: Synthetic polypeptide
  MOD_RES (8)..(8): SDMArg
  C-term Amide

SEQ ID NO: 298 - protein, 34 aa, Artificial Sequence; identical to SEQ ID NO: 208
  Description of Artificial Sequence: Synthetic polypeptide
  MOD_RES (8)..(8): Lys(Me2)
  C-term Amide

SEQ ID NO: 299 - protein, 34 aa, Artificial Sequence
  Description of Artificial Sequence: Synthetic polypeptide
  C-term Amide
DCLGFMRKCYPDNDKCCRPNLVCSRTHKWCKYVF

SEQ ID NO: 300 - protein, 34 aa, Artificial Sequence; identical to SEQ ID NO: 78
  Description of Artificial Sequence: Synthetic polypeptide
  MOD_RES (10)..(10): NMeTrp
  C-term Amide

SEQ ID NO: 301 - protein, 34 aa, Artificial Sequence
  Description of Artificial Sequence: Synthetic polypeptide
  C-term Amide
DCLGFMRKCVPDNDKCCRPNLVCSRTHKWCKYVF

SEQ ID NO: 302 - protein, 34 aa, Artificial Sequence
  Description of Artificial Sequence: Synthetic polypeptide
  C-term Amide
DCLGFMRKCFPDNDKCCRPNLVCSRTHKWCKYVF

SEQ ID NO: 303 - protein, 34 aa, Artificial Sequence
  Description of Artificial Sequence: Synthetic polypeptide
  C-term Amide
DCLGFMRKCLPDNDKCCRPNLVCSRTHKWCKYVF

SEQ ID NO: 304 - protein, 34 aa, Artificial Sequence
  Description of Artificial Sequence: Synthetic polypeptide
  C-term Amide
DCLGFMRKCHPDNDKCCRPNLVCSRTHKWCKYVF

SEQ ID NO: 305 - protein, 34 aa, Artificial Sequence
  Description of Artificial Sequence: Synthetic polypeptide
  C-term Amide
DCLGFMRKCSPDNDKCCRPNLVCSRTHKWCKYVF

SEQ ID NO: 306 - skipped

SEQ ID NO: 307 - protein, 34 aa, Artificial Sequence
  Description of Artificial Sequence: Synthetic polypeptide
  C-term Amide
DCLGFMRKCMPDNDKCCRPNLVCSRTHKWCKYVF

SEQ ID NO: 308 - protein, 34 aa, Artificial Sequence
  Description of Artificial Sequence: Synthetic polypeptide
  C-term Amide
DCLGFMRKCPPDNDKCCRPNLVCSRTHKWCKYVF

SEQ ID NO: 309 - protein, 34 aa, Artificial Sequence
  Description of Artificial Sequence: Synthetic polypeptide
  C-term Amide
DCLGFMRKCTPDNDKCCRPNLVCSRTHKWCKYVF

SEQ ID NO: 310 - protein, 34 aa, Artificial Sequence; identical to SEQ ID NO: 78
  Description of Artificial Sequence: Synthetic polypeptide
  MOD_RES (10)..(10): 4CO2-Phe
  C-term Amide

SEQ ID NO: 311 - protein, 34 aa, Artificial Sequence; identical to SEQ ID NO: 78
  Description of Artificial Sequence: Synthetic polypeptide
  MOD_RES (10)..(10): 2PAL
  C-term Amide

SEQ ID NO: 312 - protein, 34 aa, Artificial Sequence; identical to SEQ ID NO: 219
  Description of Artificial Sequence: Synthetic polypeptide
  MOD_RES (15)..(15): SDMArg
  C-term Amide

SEQ ID NO: 313 - protein, 34 aa, Artificial Sequence; identical to SEQ ID NO: 219
  Description of Artificial Sequence: Synthetic polypeptide
  MOD_RES (15)..(15): Lys(Me2)
  C-term Amide

SEQ ID NO: 314 - protein, 34 aa, Artificial Sequence; identical to SEQ ID NO: 116
  Description of Artificial Sequence: Synthetic polypeptide
  MOD_RES (18)..(18): Lys(Me2)
  C-term Amide

SEQ ID NO: 315 - protein, 34 aa, Artificial Sequence; identical to SEQ ID NO: 116
  Description of Artificial Sequence: Synthetic polypeptide
  MOD_RES (18)..(18): SDMArg
  C-term Amide

SEQ ID NO: 316 - protein, 34 aa, Artificial Sequence; identical to SEQ ID NO: 116
  Description of Artificial Sequence: Synthetic polypeptide
  MOD_RES (18)..(18): 2PAL
  C-term Amide

SEQ ID NO: 317 - protein, 34 aa, Artificial Sequence; identical to SEQ ID NO: 165
  Description of Artificial Sequence: Synthetic polypeptide
  MOD_RES (21)..(21): 4CO2-Phe
  C-term Amide

SEQ ID NO: 318 - protein, 34 aa, Artificial Sequence; identical to SEQ ID NO: 165
  Description of Artificial Sequence: Synthetic polypeptide
  MOD_RES (21)..(21): 2PAL
  C-term Amide

SEQ ID NO: 319 - protein, 34 aa, Artificial Sequence
  Description of Artificial Sequence: Synthetic polypeptide
  C-term Amide
DCLGFMRKCIPDNDKCCRPNLFCSRTHKWCKYVF

SEQ ID NO: 320 - protein, 34 aa, Artificial Sequence
  Description of Artificial Sequence: Synthetic polypeptide
  C-term Amide
DCLGFMRKCIPDNDKCCRPNLPCSRTHKWCKYVF

SEQ ID NO: 321 - protein, 34 aa, Artificial Sequence
  Description of Artificial Sequence: Synthetic polypeptide
  C-term Amide
DCLGFMRKCIPDNDKCCRPNLICSRTHKWCKYVF

SEQ ID NO: 322 - protein, 34 aa, Artificial Sequence
  Description of Artificial Sequence: Synthetic polypeptide
  C-term Amide
DCLGFMRKCIPDNDKCCRPNLLCSRTHKWCKYVF

SEQ ID NO: 323 - protein, 34 aa, Artificial Sequence
  Description of Artificial Sequence: Synthetic polypeptide
  C-term Amide
DCLGFMRKCIPDNDKCCRPNLSCSRTHKWCKYVF

SEQ ID NO: 324 - protein, 34 aa, Artificial Sequence
  Description of Artificial Sequence: Synthetic polypeptide
  C-term Amide
DCLGFMRKCIPDNDKCCRPNLGCSRTHKWCKYVF

SEQ ID NO: 325 - protein, 34 aa, Artificial Sequence
  Description of Artificial Sequence: Synthetic polypeptide
  C-term Amide
DCLGFMRKCIPDNDKCCRPNLNCSRTHKWCKYVF

SEQ ID NO: 326 - protein, 34 aa, Artificial Sequence
  Description of Artificial Sequence: Synthetic polypeptide
  C-term Amide
DCLGFMRKCIPDNDKCCRPNLHCSRTHKWCKYVF

SEQ ID NO: 327 - protein, 34 aa, Artificial Sequence
  Description of Artificial Sequence: Synthetic polypeptide
  C-term Amide
DCLGFMRKCIPDNDKCCRPNLDCSRTHKWCKYVF

SEQ ID NO: 328 - protein, 34 aa, Artificial Sequence; identical to SEQ ID NO: 230
  Description of Artificial Sequence: Synthetic polypeptide
  MOD_RES (22)..(22): NMePhe
  C-term Amide

SEQ ID NO: 329 - protein, 34 aa, Artificial Sequence
  Description of Artificial Sequence: Synthetic polypeptide
  C-term Amide
DCLGFMRKCIPDNDKCCRPNLTCSRTHKWCKYVF

SEQ ID NO: 330 - protein, 34 aa, Artificial Sequence; identical to SEQ ID NO: 230
  Description of Artificial Sequence: Synthetic polypeptide
  MOD_RES (22)..(22): Phg
  C-term Amide

SEQ ID NO: 331 - protein, 34 aa, Artificial Sequence
  Description of Artificial Sequence: Synthetic polypeptide
  C-term Amide
DCLGFMRKCIPDNDKCCRPNLYCSRTHKWCKYVF

SEQ ID NO: 332 - protein, 34 aa, Artificial Sequence
  Description of Artificial Sequence: Synthetic polypeptide
  C-term Amide
DCLGFMRKCIPDNDKCCRPNLMCSRTHKWCKYVF

SEQ ID NO: 333 - protein, 34 aa, Artificial Sequence; identical to SEQ ID NO: 230
  Description of Artificial Sequence: Synthetic polypeptide
  MOD_RES (22)..(22): 4CO2-Phe
  C-term Amide

SEQ ID NO: 334 - protein, 34 aa, Artificial Sequence; identical to SEQ ID NO: 230
  Description of Artificial Sequence: Synthetic polypeptide
  MOD_RES (22)..(22): 2PAL
  C-term Amide

SEQ ID NO: 335 - protein, 34 aa, Artificial Sequence; identical to SEQ ID NO: 117
  Description of Artificial Sequence: Synthetic polypeptide
  MOD_RES (25)..(25): Lys(Me2)
  C-term Amide

SEQ ID NO: 336 - protein, 34 aa, Artificial Sequence; identical to SEQ ID NO: 117
  Description of Artificial Sequence: Synthetic polypeptide
  MOD_RES (25)..(25): SDMArg
  C-term Amide

SEQ ID NO: 337 - protein, 34 aa, Artificial Sequence
  Description of Artificial Sequence: Synthetic polypeptide
  C-term Amide
DCLGFMRKCIPDNDKCCRPNLVCSRHHKWCKYVF

SEQ ID NO: 338 - protein, 34 aa, Artificial Sequence
  Description of Artificial Sequence: Synthetic polypeptide
  C-term Amide
DCLGFMRKCIPDNDKCCRPNLVCSRSHKWCKYVF

SEQ ID NO: 339 - protein, 34 aa, Artificial Sequence
  Description of Artificial Sequence: Synthetic polypeptide
  C-term Amide
DCLGFMRKCIPDNDKCCRPNLVCSRQHKWCKYVF

SEQ ID NO: 340 - protein, 34 aa, Artificial Sequence
  Description of Artificial Sequence: Synthetic polypeptide
  C-term Amide
DCLGFMRKCIPDNDKCCRPNLVCSRYHKWCKYVF

SEQ ID NO: 341 - protein, 34 aa, Artificial Sequence
  Description of Artificial Sequence: Synthetic polypeptide
  C-term Amide
DCLGFMRKCIPDNDKCCRPNLVCSRFHKWCKYVF

SEQ ID NO: 342 - protein, 34 aa, Artificial Sequence
  Description of Artificial Sequence: Synthetic polypeptide
  C-term Amide
DCLGFMRKCIPDNDKCCRPNLVCSRNHKWCKYVF

SEQ ID NO: 343 - protein, 34 aa, Artificial Sequence
  Description of Artificial Sequence: Synthetic polypeptide
  C-term Amide
DCLGFMRKCIPDNDKCCRPNLVCSRGHKWCKYVF

SEQ ID NO: 344 - protein, 34 aa, Artificial Sequence
  Description of Artificial Sequence: Synthetic polypeptide
  C-term Amide
DCLGFMRKCIPDNDKCCRPNLVCSRVHKWCKYVF

SEQ ID NO: 345 - protein, 34 aa, Artificial Sequence
  Description of Artificial Sequence: Synthetic polypeptide
  C-term Amide
DCLGFMRKCIPDNDKCCRPNLVCSRPHKWCKYVF

SEQ ID NO: 346 - protein, 34 aa, Artificial Sequence
  Description of Artificial Sequence: Synthetic polypeptide
  C-term Amide
DCLGFMRKCIPDNDKCCRPNLVCSRMHKWCKYVF

SEQ ID NO: 347 - protein, 34 aa, Artificial Sequence
  Description of Artificial Sequence: Synthetic polypeptide
  C-term Amide
DCLGFMRKCIPDNDKCCRPNLVCSRDHKWCKYVF

SEQ ID NO: 348 - protein, 34 aa, Artificial Sequence
  Description of Artificial Sequence: Synthetic polypeptide
  C-term Amide
DCLGFMRKCIPDNDKCCRPNLVCSRIHKWCKYVF

SEQ ID NO: 349 - protein, 34 aa, Artificial Sequence; identical to SEQ ID NO: 237
  Description of Artificial Sequence: Synthetic polypeptide
  MOD_RES (26)..(26): 2PAL
  C-term Amide

SEQ ID NO: 350 - protein, 34 aa, Artificial Sequence; identical to SEQ ID NO: 237
  Description of Artificial Sequence: Synthetic polypeptide
  MOD_RES (26)..(26): 4CO2-Phe
  C-term Amide

SEQ ID NO: 351 - protein, 34 aa, Artificial Sequence; identical to SEQ ID NO: 166
  Description of Artificial Sequence: Synthetic polypeptide
  MOD_RES (27)..(27): 4CO2-Phe
  C-term Amide

SEQ ID NO: 352 - protein, 34 aa, Artificial Sequence; identical to SEQ ID NO: 166
  Description of Artificial Sequence: Synthetic polypeptide
  MOD_RES (27)..(27): 2PAL
  C-term Amide

SEQ ID NO: 353 - protein, 34 aa, Artificial Sequence; identical to SEQ ID NO: 166
  Description of Artificial Sequence: Synthetic polypeptide
  MOD_RES (27)..(27): SDMArg
  C-term Amide

SEQ ID NO: 354 - protein, 34 aa, Artificial Sequence; identical to SEQ ID NO: 166
  Description of Artificial Sequence: Synthetic polypeptide
  MOD_RES (27)..(27): Lys(Me2)
  C-term Amide

SEQ ID NO: 355 - protein, 34 aa, Artificial Sequence; identical to SEQ ID NO: 239
  Description of Artificial Sequence: Synthetic polypeptide
  MOD_RES (28)..(28): Lys(Me2)
  C-term Amide

SEQ ID NO: 356 - protein, 34 aa, Artificial Sequence; identical to SEQ ID NO: 239
  Description of Artificial Sequence: Synthetic polypeptide
  MOD_RES (28)..(28): SDMArg
  C-term Amide

SEQ ID NO: 357 - protein, 34 aa, Artificial Sequence; identical to SEQ ID NO: 79
  Description of Artificial Sequence: Synthetic polypeptide
  MOD_RES (29)..(29): NMeTrp
  C-term Amide

SEQ ID NO: 358 - protein, 34 aa, Artificial Sequence; identical to SEQ ID NO: 79
  Description of Artificial Sequence: Synthetic polypeptide
  MOD_RES (29)..(29): pI-Phe
  C-term Amide

SEQ ID NO: 359 - protein, 34 aa, Artificial Sequence; identical to SEQ ID NO: 79
  Description of Artificial Sequence: Synthetic polypeptide
  MOD_RES (29)..(29): NMePhe
  C-term Amide

SEQ ID NO: 360 - protein, 34 aa, Artificial Sequence; identical to SEQ ID NO: 79
  Description of Artificial Sequence: Synthetic polypeptide
  MOD_RES (29)..(29): Bip
  C-term Amide

SEQ ID NO: 361 - protein, 34 aa, Artificial Sequence; identical to SEQ ID NO: 79
  Description of Artificial Sequence: Synthetic polypeptide
  MOD_RES (29)..(29): 1'NMeTrp
  C-term Amide

SEQ ID NO: 362 - protein, 34 aa, Artificial Sequence; identical to SEQ ID NO: 79
  Description of Artificial Sequence: Synthetic polypeptide
  MOD_RES (29)..(29): Phg
  C-term Amide

SEQ ID NO: 363 - protein, 34 aa, Artificial Sequence; identical to SEQ ID NO: 79
  Description of Artificial Sequence: Synthetic polypeptide
  MOD_RES (29)..(29): 4CO2-Phe
  C-term Amide

SEQ ID NO: 364 - protein, 34 aa, Artificial Sequence; identical to SEQ ID NO: 240
  Description of Artificial Sequence: Synthetic polypeptide
  MOD_RES (31)..(31): 2PAL
  C-term Amide

SEQ ID NO: 365 - protein, 34 aa, Artificial Sequence; identical to SEQ ID NO: 240
  Description of Artificial Sequence: Synthetic polypeptide
  MOD_RES (31)..(31): SDMArg
  C-term Amide

SEQ ID NO: 366 - protein, 34 aa, Artificial Sequence
  Description of Artificial Sequence: Synthetic polypeptide
  C-term Amide
DCLGFMRKCIPDNDKCCRPNLVCSRTHKWCKQVF

SEQ ID NO: 367 - protein, 34 aa, Artificial Sequence
  Description of Artificial Sequence: Synthetic polypeptide
  C-term Amide
DCLGFMRKCIPDNDKCCRPNLVCSRTHKWCKIVF

SEQ ID NO: 368 - protein, 34 aa, Artificial Sequence
  Description of Artificial Sequence: Synthetic polypeptide
  C-term Amide
DCLGFMRKCIPDNDKCCRPNLVCSRTHKWCKMVF

SEQ ID NO: 369 - protein, 34 aa, Artificial Sequence
  Description of Artificial Sequence: Synthetic polypeptide
  C-term Amide
DCLGFMRKCIPDNDKCCRPNLVCSRTHKWCKTVF

SEQ ID NO: 370 - protein, 34 aa, Artificial Sequence; identical to SEQ ID NO: 167
  Description of Artificial Sequence: Synthetic polypeptide
  MOD_RES (32)..(32): NMePhe
  C-term Amide

SEQ ID NO: 371 - protein, 34 aa, Artificial Sequence; identical to SEQ ID NO: 167
  Description of Artificial Sequence: Synthetic polypeptide
  MOD_RES (32)..(32): NMeTrp
  C-term Amide

SEQ ID NO: 372 - protein, 34 aa, Artificial Sequence
  Description of Artificial Sequence: Synthetic polypeptide
  C-term Amide
DCLGFMRKCIPDNDKCCRPNLVCSRTHKWCKVVF

SEQ ID NO: 373 - protein, 34 aa, Artificial Sequence
  Description of Artificial Sequence: Synthetic polypeptide
  C-term Amide
DCLGFMRKCIPDNDKCCRPNLVCSRTHKWCKLVF

SEQ ID NO: 374 - protein, 34 aa, Artificial Sequence; identical to SEQ ID NO: 167
  Description of Artificial Sequence: Synthetic polypeptide
  MOD_RES (32)..(32): Phg
  C-term Amide

SEQ ID NO: 375 - protein, 34 aa, Artificial Sequence; identical to SEQ ID NO: 167
  Description of Artificial Sequence: Synthetic polypeptide
  MOD_RES (32)..(32): Cha
  C-term Amide

SEQ ID NO: 376 - protein, 34 aa, Artificial Sequence; identical to SEQ ID NO: 167
  Description of Artificial Sequence: Synthetic polypeptide
  MOD_RES (32)..(32): Bip
  C-term Amide

SEQ ID NO: 377 - protein, 34 aa, Artificial Sequence
  Description of Artificial Sequence: Synthetic polypeptide
  C-term Amide
DCLGFMRKCIPDNDKCCRPNLVCSRTHKWCKFVF

SEQ ID NO: 378 - protein, 34 aa, Artificial Sequence
  Description of Artificial Sequence: Synthetic polypeptide
  C-term Amide
DCLGFMRKCIPDNDKCCRPNLVCSRTHKWCKGVF

SEQ ID NO: 379 - protein, 34 aa, Artificial Sequence
  Description of Artificial Sequence: Synthetic polypeptide
  C-term Amide
DCLGFMRKCIPDNDKCCRPNLVCSRTHKWCKNVF

SEQ ID NO: 380 - protein, 34 aa, Artificial Sequence
  Description of Artificial Sequence: Synthetic polypeptide
  C-term Amide
DCLGFMRKCIPDNDKCCRPNLVCSRTHKWCKHVF

SEQ ID NO: 381 - protein, 34 aa, Artificial Sequence; identical to SEQ ID NO: 167
  Description of Artificial Sequence: Synthetic polypeptide
  MOD_RES (32)..(32): pI-Phe
  C-term Amide

SEQ ID NO: 382 - protein, 34 aa, Artificial Sequence
  Description of Artificial Sequence: Synthetic polypeptide
  C-term Amide
DCLGFMRKCIPDNDKCCRPNLVCSRTHKWCKSVF

SEQ ID NO: 383 - protein, 34 aa, Artificial Sequence
  Description of Artificial Sequence: Synthetic polypeptide
  C-term Amide
DCLGFMRKCIPDNDKCCRPNLVCSRTHKWCKPVF

SEQ ID NO: 384 - protein, 34 aa, Artificial Sequence; identical to SEQ ID NO: 167
  Description of Artificial Sequence: Synthetic polypeptide
  MOD_RES (32)..(32): 2PAL
  C-term Amide

SEQ ID NO: 385 - protein, 34 aa, Artificial Sequence; identical to SEQ ID NO: 167
  Description of Artificial Sequence: Synthetic polypeptide
  MOD_RES (32)..(32): 4CO2-Phe
  C-term Amide

SEQ ID NO: 386 - protein, 34 aa, Artificial Sequence; identical to SEQ ID NO: 168
  Description of Artificial Sequence: Synthetic polypeptide
  MOD_RES (33)..(33): Cha
  C-term Amide

SEQ ID NO: 387 - skipped

SEQ ID NO: 388 - protein, 34 aa, Artificial Sequence; identical to SEQ ID NO: 168
  Description of Artificial Sequence: Synthetic polypeptide
  MOD_RES (33)..(33): NMePhe
  C-term Amide

SEQ ID NO: 389 - protein, 34 aa, Artificial Sequence; identical to SEQ ID NO: 168
  Description of Artificial Sequence: Synthetic polypeptide
  MOD_RES (33)..(33): NMeTrp
  C-term Amide

SEQ ID NO: 390 - protein, 34 aa, Artificial Sequence
  Description of Artificial Sequence: Synthetic polypeptide
  C-term Amide
DCLGFMRKCIPDNDKCCRPNLVCSRTHKWCKYFF

SEQ ID NO: 391 - protein, 34 aa, Artificial Sequence
  Description of Artificial Sequence: Synthetic polypeptide
  C-term Amide
DCLGFMRKCIPDNDKCCRPNLVCSRTHKWCKYMF

SEQ ID NO: 392 - protein, 34 aa, Artificial Sequence
  Description of Artificial Sequence: Synthetic polypeptide
  C-term Amide
DCLGFMRKCIPDNDKCCRPNLVCSRTHKWCKYHF

SEQ ID NO: 393 - protein, 34 aa, Artificial Sequence; identical to SEQ ID NO: 168
  Description of Artificial Sequence: Synthetic polypeptide
  MOD_RES (33)..(33): Phg
  C-term Amide

SEQ ID NO: 394 - protein, 34 aa, Artificial Sequence
  Description of Artificial Sequence: Synthetic polypeptide
  C-term Amide
DCLGFMRKCIPDNDKCCRPNLVCSRTHKWCKYNF

SEQ ID NO: 395 - protein, 34 aa, Artificial Sequence
  Description of Artificial Sequence: Synthetic polypeptide
  C-term Amide
DCLGFMRKCIPDNDKCCRPNLVCSRTHKWCKYDF

SEQ ID NO: 396 - protein, 34 aa, Artificial Sequence
  Description of Artificial Sequence: Synthetic polypeptide
  C-term Amide
DCLGFMRKCIPDNDKCCRPNLVCSRTHKWCKYTF

SEQ ID NO: 397 - protein, 34 aa, Artificial Sequence
  Description of Artificial Sequence: Synthetic polypeptide
  C-term Amide
DCLGFMRKCIPDNDKCCRPNLVCSRTHKWCKYSF

SEQ ID NO: 398 - protein, 34 aa, Artificial Sequence
  Description of Artificial Sequence: Synthetic polypeptide
  C-term Amide
DCLGFMRKCIPDNDKCCRPNLVCSRTHKWCKYPF

SEQ ID NO: 399 - protein, 34 aa, Artificial Sequence
  Description of Artificial Sequence: Synthetic polypeptide
  C-term Amide
DCLGFMRKCIPDNDKCCRPNLVCSRTHKWCKYYF

SEQ ID NO: 400 - protein, 34 aa, Artificial Sequence
  Description of Artificial Sequence: Synthetic polypeptide
  C-term Amide
DCLGFMRKCIPDNDKCCRPNLVCSRTHKWCKYLF

SEQ ID NO: 401 - protein, 34 aa, Artificial Sequence
  Description of Artificial Sequence: Synthetic polypeptide
  C-term Amide
DCLGFMRKCIPDNDKCCRPNLVCSRTHKWCKYGF

SEQ ID NO: 402 - protein, 34 aa, Artificial Sequence; identical to SEQ ID NO: 168
  Description of Artificial Sequence: Synthetic polypeptide
  MOD_RES (33)..(33): 2PAL
  C-term Amide

SEQ ID NO: 403 - protein, 34 aa, Artificial Sequence; identical to SEQ ID NO: 168
  Description of Artificial Sequence: Synthetic polypeptide
  MOD_RES (33)..(33): 4CO2-Phe
  C-term Amide

SEQ ID NO: 404 - protein, 34 aa, Artificial Sequence; identical to SEQ ID NO: 1
  Description of Artificial Sequence: Synthetic polypeptide
  MOD_RES (34)..(34): D-amino acid
  C-term Amide

SEQ ID NO: 405 - protein, 34 aa, Artificial Sequence; identical to SEQ ID NO: 80
  Description of Artificial Sequence: Synthetic polypeptide
  MOD_RES (34)..(34): Cha
  C-term Amide

SEQ ID NO: 406 - protein, 34 aa, Artificial Sequence; identical to SEQ ID NO: 80
  Description of Artificial Sequence: Synthetic polypeptide
  MOD_RES (34)..(34): Phg
  C-term Amide

SEQ ID NO: 407 - protein, 34 aa, Artificial Sequence; identical to SEQ ID NO: 80
  Description of Artificial Sequence: Synthetic polypeptide
  MOD_RES (34)..(34): NMeTrp
  C-term Amide

SEQ ID NO: 408 - protein, 34 aa, Artificial Sequence; identical to SEQ ID NO: 80
  Description of Artificial Sequence: Synthetic polypeptide
  MOD_RES (34)..(34): NMePhe
  C-term Amide

SEQ ID NO: 409 - protein, 34 aa, Artificial Sequence; identical to SEQ ID NO: 80
  Description of Artificial Sequence: Synthetic polypeptide
  MOD_RES (34)..(34): 1'NMeTrp
  C-term Amide

SEQ ID NO: 410 - protein, 34 aa, Artificial Sequence; identical to SEQ ID NO: 80
  Description of Artificial Sequence: Synthetic polypeptide
  MOD_RES (34)..(34): 4CO2-Phe
  C-term Amide

SEQ ID NO: 411 - protein, 34 aa, Artificial Sequence; identical to SEQ ID NO: 80
  Description of Artificial Sequence: Synthetic polypeptide
  MOD_RES (34)..(34): 2PAL
  C-term Amide

SEQ ID NO: 412 - protein, 35 aa, Artificial Sequence; identical to SEQ ID NO: 131
  Description of Artificial Sequence: Synthetic polypeptide
  MOD_RES (35)..(35): 2-Nal
  C-term Amide

SEQ ID NO: 413 - protein, 35 aa, Artificial Sequence; identical to SEQ ID NO: 131
  Description of Artificial Sequence: Synthetic polypeptide
  MOD_RES (35)..(35): 4CO2-Phe
  C-term Amide

SEQ ID NO: 414 - protein, 35 aa, Artificial Sequence; identical to SEQ ID NO: 131
  Description of Artificial Sequence: Synthetic polypeptide
  MOD_RES (35)..(35): 2PAL
  C-term Amide

SEQ ID NO: 415 - protein, 33 aa, Artificial Sequence
  Description of Artificial Sequence: Synthetic polypeptide
  C-term Amide
DCLGFMRKCIPDNDKCCRPNLVCSRTHKWCKYV

SEQ ID NO: 416 - protein, 32 aa, Artificial Sequence
  Description of Artificial Sequence: Synthetic polypeptide
  C-term Amide
DCLGFMRKCIPDNDKCCRPNLVCSRTHKWCKY

SEQ ID NO: 417 - protein, 31 aa, Artificial Sequence
  Description of Artificial Sequence: Synthetic polypeptide
  C-term Amide
DCLGFMRKCIPDNDKCCRPNLVCSRTHKWCK

SEQ ID NO: 418 - protein, 30 aa, Artificial Sequence
  Description of Artificial Sequence: Synthetic polypeptide
  C-term Amide
DCLGFMRKCIPDNDKCCRPNLVCSRTHKWC

SEQ ID NO: 419 - protein, 34 aa, Artificial Sequence
  Description of Artificial Sequence: Synthetic polypeptide
  C-term Amide
DCLGAMRKCIPDNDKCCRPNLVCSRTHKWCKYEF

SEQ ID NO: 420 - protein, 34 aa, Artificial Sequence
  Description of Artificial Sequence: Synthetic polypeptide
  MOD_RES (33)..(33): 1-Nal
  C-term Amide
DCLGAMRKCIPDNDKCCRPNLVCSRTHRWCKYXF

SEQ ID NO: 421 - protein, 34 aa, Artificial Sequence
  Description of Artificial Sequence: Synthetic polypeptide
  MOD_RES (20)..(20): 1-Nal
  C-term Amide
DCLGAMRKCIPDNDKCCRPXLVCSRTHKWCKYVF

SEQ ID NO: 422 - protein, 34 aa, Artificial Sequence
  Description of Artificial Sequence: Synthetic polypeptide
  C-term Amide
DCLGAMRKCIPDNDKCCRPWLVCSRTHKWCKYVF

SEQ ID NO: 423 - protein, 34 aa, Artificial Sequence
  Description of Artificial Sequence: Synthetic polypeptide
  C-term Amide
DCLGAMRKCIPWNDKCCRPNLVCSRTHKWCKYVF

SEQ ID NO: 424 - protein, 34 aa, Artificial Sequence
  Description of Artificial Sequence: Synthetic polypeptide
  C-term Amide
DCLWAMRKCIPDNDKCCRPNLVCSRTHKWCKYVF

SEQ ID NO: 425 - protein, 34 aa, Artificial Sequence
  Description of Artificial Sequence: Synthetic polypeptide
  MOD_RES (1)..(1): 1-Nal
  C-term Amide
XCLGAMRKCIPDNDKCCRPNLVCSRTHKWCKYVF

SEQ ID NO: 426 - protein, 34 aa, Artificial Sequence
  Description of Artificial Sequence: Synthetic polypeptide
  C-term Amide
DCLGAMRKCIPDNDKCCRPNLVCSRTHKWCKYAF

SEQ ID NO: 427 - protein, 34 aa, Artificial Sequence
  Description of Artificial Sequence: Synthetic polypeptide
  MOD_RES (13)..(13): 1-Nal
  C-term Amide
DCLGAMRKCIPDXDKCCRPNLVCSRTHKWCKYVF

SEQ ID NO: 428 - protein, 34 aa, Artificial Sequence
  Description of Artificial Sequence: Synthetic polypeptide
  C-term Amide
DCLGAMRKCIPDWDKCCRPNLVCSRTHKWCKYVF

SEQ ID NO: 429 - protein, 34 aa, Artificial Sequence
  Description of Artificial Sequence: Synthetic polypeptide
  C-term Amide
DCLEAMRKCIPDNDKCCRPNLVCSRTHKWCKYVF

SEQ ID NO: 430 - protein, 34 aa, Artificial Sequence
  Description of Artificial Sequence: Synthetic polypeptide
  C-term Amide
DCLGAMRKCIPDNDKCCRPNLVCSRTHKWCKYVE

SEQ ID NO: 431 - protein, 34 aa, Artificial Sequence
  Description of Artificial Sequence: Synthetic polypeptide
  C-term Amide
DCLGAMRKCIPDNDKCCRPNLVCSRTHKWCKYVA

SEQ ID NO: 432 - protein, 34 aa, Artificial Sequence
  Description of Artificial Sequence: Synthetic polypeptide
  C-term Amide
DCLGAMRKCIPDNDKCCRPNLVCSRTHKWCKAVF

SEQ ID NO: 433 - protein, 34 aa, Artificial Sequence
  Description of Artificial Sequence: Synthetic polypeptide
  C-term Amide
DCLGAMRKCIPDNDKCCRPNLVCSRTHKWCAYVF

SEQ ID NO: 434 - protein, 34 aa, Artificial Sequence
  Description of Artificial Sequence: Synthetic polypeptide
  C-term Amide
DCLGAMRKCIPDNDKCCRPNLVCSRTHKACKYVF

SEQ ID NO: 435 - protein, 34 aa, Artificial Sequence
  Description of Artificial Sequence: Synthetic polypeptide
  C-term Amide
DCLGAMRKCIPDNDKCCRPNLVCSRTHEWCKYVF

SEQ ID NO: 436 - protein, 34 aa, Artificial Sequence
  Description of Artificial Sequence: Synthetic polypeptide
  C-term Amide
DCLGAMEKCIPDNDKCCRPNLVCSRTHKWCKYVF

SEQ ID NO: 437 - protein, 34 aa, Artificial Sequence
  Description of Artificial Sequence: Synthetic polypeptide
  C-term Amide
DCLGAMRKCIPDNDKCCRPNLVCSRTHKECKYVF

SEQ ID NO: 438 - protein, 34 aa, Artificial Sequence
  Description of Artificial Sequence: Synthetic polypeptide
  C-term Amide
DCLGAMRKCIPDNDKCCRPNLVCSETHKWCKYVF

SEQ ID NO: 439 - protein, 34 aa, Artificial Sequence
  Description of Artificial Sequence: Synthetic polypeptide
  C-term Amide
DCLGAMRKCIPDNDECCRPNLVCSRTHKWCKYVF

SEQ ID NO: 440 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKWVF

SEQ ID NO: 441 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHRWCKYVF

SEQ ID NO: 442 - protein, 34 aa, Artificial Sequence
  Description of Artificial Sequence: Synthetic polypeptide
  MOD_RES (33)..(33): 1-Nal
  C-term Amide
DCLGFMRKCIPDNDKCCRPNLVCSRTHRWCKYXF

SEQ ID NO: 443 - protein, 34 aa, Artificial Sequence
  Description of Artificial Sequence: Synthetic polypeptide
  C-term Amide
DCLGFMRKCIPDNDKCCRPNLVCSRTHRWCKWVF

SEQ ID NO: 444 - protein, 34 aa, Artificial Sequence
  Description of Artificial Sequence: Synthetic polypeptide
  C-term Amide
DCLGFMRKCIPDNDKCCRPNLVCSRTHRWCKYWF

SEQ ID NO: 445 - protein, 34 aa, Artificial Sequence
  Description of Artificial Sequence: Synthetic polypeptide
  C-term Amide
DCLGFMRKCIPDNDKCCRPNLVCSRLHRWCKYVF

SEQ ID NO: 446 - protein, 34 aa, Artificial Sequence
  Description of Artificial Sequence: Synthetic polypeptide
  C-term Amide
DCLGFMRKCIPDNDKCCRPNLVCSRLHKWCKWVF

SEQ ID NO: 447 - protein, 34 aa, Artificial Sequence
  Description of Artificial Sequence: Synthetic polypeptide
  C-term Amide
DCLGFMRKCIPDNDKCCRPNLVCSRLHKWCKYWF

SEQ ID NO: 448 - protein, 34 aa, Artificial Sequence
  Description of Artificial Sequence: Synthetic polypeptide
  C-term Amide
DCLGFWRKCIPDNDKCCRPNLVCSRTHRWCKYVF

SEQ ID NO: 449 - protein, 34 aa, Artificial Sequence
  Description of Artificial Sequence: Synthetic polypeptide
  C-term Amide
DCLGFWRKCIPDNDKCCRPNLVCSRTHKWCKWVF

SEQ ID NO: 450 - protein, 34 aa, Artificial Sequence
  Description of Artificial Sequence: Synthetic polypeptide
  C-term Amide
DCLGFMRKCIPDNDKCCRPNLVCSRTHKWCKWWF

SEQ ID NO: 451 - protein, 34 aa, Artificial Sequence
  Description of Artificial Sequence: Synthetic polypeptide
  MOD_RES (6)..(6): 1-Nal
  C-term Amide
DCLGFXRKCIPDNDKCCRPNLVCSRTHKWCKWVF

SEQ ID NO: 452 - protein, 34 aa, Artificial Sequence
  Description of Artificial Sequence: Synthetic polypeptide
  MOD_RES (10)..(10): 1-Nal
  MOD_RES (32)..(32): 1-Nal
  C-term Amide
DCLGFMRKCXPDNDKCCRPNLVCSRTHKWCKXVF

SEQ ID NO: 453 - protein, 34 aa, Artificial Sequence
  Description of Artificial Sequence: Synthetic polypeptide
  MOD_RES (32)..(32): 1-Nal
  C-term Amide
DCLGFMRKCIPDNDKCCRPNLVCSRLHKWCKXVF

SEQ ID NO: 454 - protein, 34 aa, Artificial Sequence
  Description of Artificial Sequence: Synthetic polypeptide
  MOD_RES (6)..(6): 1-Nal
  C-term Amide
DCLGFXRKCIPDNDKCCRPNLVCSRTHRWCKYVF

SEQ ID NO: 455 - protein, 34 aa, Artificial Sequence
  Description of Artificial Sequence: Synthetic polypeptide
  MOD_RES (33)..(33): 1-Nal
  C-term Amide
DCLGFMRKCIPDNDKCCRPNLVCSRTHKWCKWXF

SEQ ID NO: 456 - protein, 34 aa, Artificial Sequence
  Description of Artificial Sequence: Synthetic polypeptide
  C-term Amide
DCLGFWRKCIPDNDKCCRPNLVCSRLHKWCKYVF

SEQ ID NO: 457 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRLHKWCKYVF

SEQ ID NO: 458 - protein, 34 aa, Artificial Sequence
  Description of Artificial Sequence: Synthetic polypeptide
  MOD_RES (10)..(10): 1-Nal
  C-term Amide
DCLGFWRKCXPDNDKCCRPNLVCSRTHKWCKYVF

SEQ ID NO: 459 - protein, 34 aa, Artificial Sequence
  Description of Artificial Sequence: Synthetic polypeptide
  MOD_RES (10)..(10): 1-Nal
  C-term Amide
DCLGFMRKCXPWNDKCCRPNLVCSRTHKWCKYVF

SEQ ID NO: 460 - protein, 34 aa, Artificial Sequence
  Description of Artificial Sequence: Synthetic polypeptide
  MOD_RES (32)..(32): 1-Nal
  C-term Amide
DCLGFMRKCIPDNDKCCRPNLVCSRTHKWCKXWF

SEQ ID NO: 461 - protein, 34 aa, Artificial Sequence
  Description of Artificial Sequence: Synthetic polypeptide
  MOD_RES (33)..(33): 1-Nal
  C-term Amide
DCLGFWRKCIPDNDKCCRPNLVCSRTHKWCKYXF

SEQ ID NO: 462 - protein, 34 aa, Artificial Sequence
  Description of Artificial Sequence: Synthetic polypeptide
  MOD_RES (10)..(10): 1-Nal
  MOD_RES (33)..(33): 1-Nal
  C-term Amide
DCLGFMRKCXPDNDKCCRPNLVCSRTHKWCKYXF

SEQ ID NO: 463 - protein, 34 aa, Artificial Sequence
  Description of Artificial Sequence: Synthetic polypeptide
  MOD_RES (33)..(33): 1-Nal
  C-term Amide
DCLGFMRKCIPDNDKCCRPNLVCSRLHKWCKYXF

SEQ ID NO: 464 - protein, 35 aa, Artificial Sequence
  Description of Artificial Sequence: Synthetic polypeptide
  MOD_RES (11)..(11): 1-Nal
  C-term Amide
WDCLGFMRKCXPDNDKCCRPNLVCSRTHKWCKYVF

SEQ ID NO: 465 - protein, 34 aa, Artificial Sequence
  Description of Artificial Sequence: Synthetic polypeptide
  MOD_RES (10)..(10): 1-Nal
  C-term Amide
WCLGFMRKCXPDNDKCCRPNLVCSRTHKWCKYVF

SEQ ID NO: 466 - protein, 34 aa, Artificial Sequence
  Description of Artificial Sequence: Synthetic polypeptide
  MOD_RES (1)..(1): 1-Nal
  MOD_RES (10)..(10): 1-Nal
  C-term Amide
XCLGFMRKCXPDNDKCCRPNLVCSRTHKWCKYVF

SEQ ID NO: 467 - protein, 34 aa, Grammostola porteri
  C-term Amide
DCLGFMRKCSPDNDKCCRPNLVCSRKHKWCKYEI

SEQ ID NO: 468 - protein, 33 aa, Grammostola porteri
  C-term Amide
DCLGWFKGCDPDNDKCCEGYKCNRRDKWCKYKL

SEQ ID NO: 469 - protein, 33 aa, Grammostola porteri
  C-term Amide
DCLGWFKGCDPDNDKCCENYKCNRREQWCKYKL

SEQ ID NO: 470 - protein, 35 aa, Grammostola porteri; identical to SEQ ID NO: 60

SEQ ID NO: 471 - protein, 35 aa, Grammostola porteri
DCLGWFKGCDPDNDKCCEGYKCNRRDKWCKYKLWK

SEQ ID NO: 472 - protein, 34 aa, Grammostola porteri
DCLGWFKGCDPDNDKCCEGYKCNRRDKWCKYKLW

SEQ ID NO: 473 - protein, 35 aa, Grammostola porteri
DCLGWFKGCDPDNDKCCENYKCNRRDKWCKYKLWK

SEQ ID NO: 474 - protein, 34 aa, Grammostola porteri
DCLGWFKGCDPDNDKCCENYKCNRRDKWCKYKLW

SEQ ID NO: 475 - protein, 38 aa, Artificial Sequence
  Description of Artificial Sequence: Synthetic polypeptide
  N-term is optionally acetylated, biotinylated, 4-pentynoylated or PEGylated
  MOD_RES (1)..(1): Any amino acid or absent
  MOD_RES (2)..(2): Any amino acid or absent
  MOD_RES (3)..(3): Cys, SeCys or any alykyl amino acid
  MOD_RES (4)..(4): Any acidic, hydrophobic, basic or neutral hydrophilic amino acid
  MOD_RES (5)..(5): Gly, Ala or any hydrophobic or basic amino acid
  MOD_RES (6)..(6): Gly, Ala, 2-Abu, Nle, Nva or any hydrophobic amino acid
  MOD_RES (7)..(7): Gly, Ala or any aromatic or hydrophobic amino acid
  MOD_RES (8)..(8): Any basic, acidic or neutral hydrophilic amino acid or Ala
  MOD_RES (9)..(9): Any basic or neutral hydrophilic amino acid
  MOD_RES (10)..(10): Cys or SeCys
  MOD_RES (11)..(11): Any amino acid
  MOD_RES (12)..(12): Pro or any acidic, neutral or hydrophobic amino acid
  MOD_RES (13)..(13): Any amino acid
  MOD_RES (14)..(14): Any amino acid
  MOD_RES (16)..(16): Any basic, neutral hydrophilic or acidic amino acid or Ala
  MOD_RES (17)..(17): Cys or SeCys
  MOD_RES (18)..(18): Cys, SeCys or any alkyl amino acid
  MOD_RES (19)..(19): Any amino acid
  MOD_RES (20)..(20): Pro, Gly or any basic or neutral hydrophilic amino acid
  MOD_RES (21)..(21): Any basic, hydrophobic or neutral hydrophilic amino acid
  MOD_RES (22)..(22): Any hydrophobic or basic amino acid
  MOD_RES (23)..(23): Any hydrophobic, basic or neutral hydrophilic amino acid
  MOD_RES (24)..(24): Cys or SeCys
  MOD_RES (25)..(25): Ser, Ala or any neutral hydrophilic amino acid
  MOD_RES (26)..(26): Ala or any acidic, basic or neutral hydrophilic amino acid
  MOD_RES (27)..(27): Any acidic, basic, neutral hydrophilic or hydrophobic amino acid
  MOD_RES (28)..(28): Any aromatic or basic amino acid
  MOD_RES (29)..(29): Any acidic, basic or neutral hydrophilic amino acid
  MOD_RES (30)..(30): Trp, 5-bromoTrp, 6-bromoTrp, 1-Nal, 2-Nal, 5-chloroTrp, 6-chloroTrp or thioTrp
  MOD_RES (31)..(31): Cys or SeCys
  MOD_RES (33)..(33): Any hydrophobic or aromatic amino acid
  MOD_RES (34)..(34): Any amino acid
  MOD_RES (35)..(35): Any hydrophobic amino acid
  MOD_RES (36)..(36): Any neutral, basic or hydrophobic amino acid or absent
  MOD_RES (37)..(37): Any neutral, basic or hydrophobic amino acid or absent
  MOD_RES (38)..(38): Any neutral, basic or hydrophobic amino acid or absent
  C-term optionally amidated
  see specification as filed for detailed description of substitutions and preferred embodiments
XXXXXXXXXXXXXXDXXXXXXXXXXXXXXXXKXXXXXX

SEQ ID NO: 476 - protein, 38 aa, Artificial Sequence
  Description of Artificial Sequence: Synthetic polypeptide
  N-term is optionally acetylated, biotinylated, 4-pentynoylated or PEGylated
  MOD_RES (1)..(1): Any amino acid or absent
  MOD_RES (2)..(2): Any amino acid or absent
  MOD_RES (4)..(4): Any acidic, hydrophobic, basic or neutral hydrophilic amino acid
  MOD_RES (5)..(5): Gly, Ala or any hydrophobic or basic amino acid
  MOD_RES (7)..(7): Gly, Ala or any aromatic or hydrophobic amino acid
  MOD_RES (8)..(8): Any basic, acidic, or neutral hydrophobic amino acid or Ala
  MOD_RES (9)..(9): Any basic or neutral hydrophilic amino acid
  MOD_RES (11)..(11): Any amino acid
  MOD_RES (12)..(12): Pro or any acidic, neutral or hydrophobic amino acid
  MOD_RES (13)..(13): Any amino acid
  MOD_RES (14)..(14): Any amino acid
  MOD_RES (16)..(16): Any basic, neutral hydrophilic or acidic amino acid or Ala
  MOD_RES (19)..(19): Any amino acid
  MOD_RES (20)..(20): Pro, Gly or any basic or neutral hydrophilic amino acid
  MOD_RES (21)..(21): Any basic, hydrophobic or neutral hydrophilic amino acid
  MOD_RES (22)..(22): Any hydrophobic or basic amino acid
  MOD_RES (23)..(23): Any hydrophobic, basic or neutral hydrophilic amino acid
  MOD_RES (25)..(25): Ser, Ala or any neutral hydrophilic amino acid
  MOD_RES (26)..(26): Ala or any acidic, basic or neutral hydrophilic amino acid
  MOD_RES (27)..(27): Any acidic, basic, neutral hydrophilic or hydrophobic amino acid
  MOD_RES (28)..(28): Any aromatic or basic amino acid
  MOD_RES (29)..(29): Any acidic, basic or neutral hydrophilic amino acid
  MOD_RES (30)..(30): Trp, 5-bromoTrp, 6-bromoTrp, 1-Nal, 2-Nal, 5-chloroTrp, 6-chloroTrp or thioTrp
  MOD_RES (33)..(33): Any hydrophobic or aromatic amino acid
  MOD_RES (34)..(34): Any amino acid
  MOD_RES (35)..(35): Any hydrophobic amino acid
  MOD_RES (36)..(36): Any neutral, basic or hydrophobic amino acid or absent
  MOD_RES (37)..(37): Any neutral, basic or hydrophobic amino acid or absent
  MOD_RES (38)..(38): Any neutral, basic or hydrophobic amino acid or absent
  C-term optionally amidated
  see specification as filed for detailed description of substitutions and preferred embodiments
XXCXXAXXXCXXXXDXCCXXXXXCXXXXXXCKXXXXXX

SEQ ID NO: 477 - protein, 20 aa, Artificial Sequence
  Description of Artificial Sequence: Synthetic peptide
GGGGSGGGGSGGGGSGGGGS

SEQ ID NO: 478 - protein, 246 aa, Artificial Sequence
  Description of Artificial Sequence: Synthetic polypeptide
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 6 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
XXNXXG

SEQ ID NO: 480 - protein, 4 aa, Artificial Sequence
  Description of Artificial Sequence: Synthetic peptide
GGGG

SEQ ID NO: 481 - protein, 5 aa, Artificial Sequence
  Description of Artificial Sequence: Synthetic peptide
GGGGG

SEQ ID NO: 482 - protein, 7 aa, Artificial Sequence
  Description of Artificial Sequence: Synthetic peptide
GGGGGGG

SEQ ID NO: 483 - protein, 15 aa, Artificial Sequence
  Description of Artificial Sequence: Synthetic peptide
GGGGSGGGGSGGGGS

SEQ ID NO: 484 - protein, 6 aa, Artificial Sequence
  Description of Artificial Sequence: Synthetic peptide
GGGGGK

SEQ ID NO: 485 - protein, 7 aa, Artificial Sequence
  Description of Artificial Sequence: Synthetic peptide
GGGGGKR

SEQ ID NO: 486 - protein, 8 aa, Artificial Sequence
  Description of Artificial Sequence: Synthetic peptide
GGGKGGGG

SEQ ID NO: 487 - protein, 8 aa, Artificial Sequence
  Description of Artificial Sequence: Synthetic peptide
GGGNGSGG

SEQ ID NO: 488 - protein, 8 aa, Artificial Sequence
  Description of Artificial Sequence: Synthetic peptide
GGGCGGGG

SEQ ID NO: 489 - protein, 5 aa, Artificial Sequence
  Description of Artificial Sequence: Synthetic peptide
GPNGG

SEQ ID NO: 490 - protein, 8 aa, Artificial Sequence
  Description of Artificial Sequence: Synthetic peptide
GGGKGGGG

SEQ ID NO: 491 - protein, 5 aa, Artificial Sequence
  Description of Artificial Sequence: Synthetic peptide
GGGGS

SEQ ID NO: 492 - protein, 10 aa, Artificial Sequence
  Description of Artificial Sequence: Synthetic peptide
GGGGSGGGGS

SEQ ID NO: 493 - protein, 25 aa, Artificial Sequence
  Description of Artificial Sequence: Synthetic peptide
GGGGSGGGGSGGGGSGGGGSGGGGS

SEQ ID NO: 494 - protein, 6 aa, Artificial Sequence
  Description of Artificial Sequence: Synthetic peptide
GGEGGG

SEQ ID NO: 495 - protein, 8 aa, Artificial Sequence
  Description of Artificial Sequence: Synthetic peptide
GGEEEGGG

SEQ ID NO: 496 - protein, 5 aa, Artificial Sequence
  Description of Artificial Sequence: Synthetic peptide
GEEEG

SEQ ID NO: 497 - protein, 4 aa, Artificial Sequence
  Description of Artificial Sequence: Synthetic peptide
GEEE

SEQ ID NO: 498 - protein, 6 aa, Artificial Sequence
  Description of Artificial Sequence: Synthetic peptide
GGDGGG

SEQ ID NO: 499 - protein, 7 aa, Artificial Sequence
  Description of Artificial Sequence: Synthetic peptide
GGDDDGG

SEQ ID NO: 500 - protein, 5 aa, Artificial Sequence
  Description of Artificial Sequence: Synthetic peptide
GDDDG

SEQ ID NO: 501 - protein, 4 aa, Artificial Sequence
  Description of Artificial Sequence: Synthetic peptide
GDDD

SEQ ID NO: 502 - protein, 21 aa, Artificial Sequence
  Description of Artificial Sequence: Synthetic peptide
GGGGSDDSDEGSDGEDGGGGS

SEQ ID NO: 503 - protein, 5 aa, Artificial Sequence
  Description of Artificial Sequence: Synthetic peptide
WEWEW

SEQ ID NO: 504 - protein, 5 aa, Artificial Sequence
  Description of Artificial Sequence: Synthetic peptide
FEFEF

SEQ ID NO: 505 - protein, 6 aa, Artificial Sequence
  Description of Artificial Sequence: Synthetic peptide
EEEWWW

SEQ ID NO: 506 - protein, 6 aa, Artificial Sequence
  Description of Artificial Sequence: Synthetic peptide
EEEFFF

SEQ ID NO: 507 - protein, 7 aa, Artificial Sequence
  Description of Artificial Sequence: Synthetic peptide
WWEEEWW

SEQ ID NO: 508 - protein, 7 aa, Artificial Sequence
  Description of Artificial Sequence: Synthetic peptide
FFEEEFF

SEQ ID NO: 509 - protein, 6 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
XXYXXG

SEQ ID NO: 510 - protein, 6 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
XXSXXG

SEQ ID NO: 511 - protein, 6 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
XXTXXG

SEQ ID NO: 512 - protein, 22 aa, Artificial Sequence
  Description of Artificial Sequence: Synthetic peptide
GSGSATGGSGSTASSGSGSATH

SEQ ID NO: 513 - protein, 22 aa, Artificial Sequence
  Description of Artificial Sequence: Synthetic peptide
HGSGSATGGSGSTASSGSGSAT

SEQ ID NO: 514 - protein, 19 aa, Artificial Sequence
  Description of Artificial Sequence: Synthetic peptide
AEAAAKEAAAKEAAAKAGG

SEQ ID NO: 515 - protein, 34 aa, Artificial Sequence
  Description of Artificial Sequence: Synthetic polypeptide
  MOD_RES (13)..(13): Atz(amino-PEG10)
  C-term Amide
DCLGFFRKCIPDXDKCCRPNLVCSRTHKWCKYVF

SEQ ID NO: 516 - protein, 34 aa, Artificial Sequence
  Description of Artificial Sequence: Synthetic polypeptide
  MOD_RES (22)..(22): Atz(amino-PEG10)
  C-term Amide
DCLGFFRKCIPDNDKCCRPNLXCSRTHKWCKYVF

SEQ ID NO: 517 - protein, 34 aa, Artificial Sequence
  Description of Artificial Sequence: Synthetic polypeptide
  MOD_RES (33)..(33): Atz(amino-PEG10)
  C-term Amide
DCLGFFRKCIPDNDKCCRPNLVCSRTHKWCKYXF

SEQ ID NO: 518 - protein, 34 aa, Artificial Sequence
  Description of Artificial Sequence: Synthetic polypeptide
  MOD_RES (1)..(1): Atz(amino-PEG10)
  C-term Amide
XCLGAFRKCIPDNDKCCRPNLVCSRTHKWCKYVF

SEQ ID NO: 519 - protein, 34 aa, Artificial Sequence
  Description of Artificial Sequence: Synthetic polypeptide
  MOD_RES (12)..(12): Atz(amino-PEG10)
  C-term Amide
DCLGAFRKCIPXNDKCCRPNLVCSRTHKWCKYVF

SEQ ID NO: 520 - protein, 34 aa, Artificial Sequence
  Description of Artificial Sequence: Synthetic polypeptide
  MOD_RES (13)..(13): Atz(amino-PEG10)
  C-term Amide
DCLGAFRKCIPDXDKCCRPNLVCSRTHKWCKYVF

SEQ ID NO: 521 - protein, 34 aa, Artificial Sequence
  Description of Artificial Sequence: Synthetic polypeptide
  MOD_RES (33)..(33): Atz(amino-PEG10)
  C-term Amide
DCLGAFRKCIPDNDKCCRPNLVCSRTHKWCKYXF

SEQ ID NO: 522 - protein, 34 aa, Artificial Sequence
  Description of Artificial Sequence: Synthetic polypeptide
  MOD_RES (33)..(33): Atz(amino-PEG10)
  MOD_RES (34)..(34): 1-Nal
  C-term Amide
DCLGFFRKCIPDNDKCCRPNLVCSRTHKWCKYXX

SEQ ID NO: 523 - protein, 34 aa, Artificial Sequence
  Description of Artificial Sequence: Synthetic polypeptide
  MOD_RES (10)..(10): Atz(amino-PEG10)
  C-term Amide
DCLGFFRKCXPDNDKCCRPNLVCSRLHKWCKYVF

SEQ ID NO: 524 - protein, 34 aa, Artificial Sequence
  Description of Artificial Sequence: Synthetic polypeptide
  MOD_RES (15)..(15): Atz(amino-PEG10)
  C-term Amide
DCLGAFRKCIPDNDXCCRPNLVCSRTHKWCKYVF

SEQ ID NO: 525 - protein, 34 aa, Artificial Sequence
  Description of Artificial Sequence: Synthetic polypeptide
  MOD_RES (22)..(22): Atz(amino-PEG10)
  C-term Amide
DCLGAFRKCIPDNDKCCRPNLXCSRTHKWCKYVF

SEQ ID NO: 526 - protein, 34 aa, Artificial Sequence
  Description of Artificial Sequence: Synthetic polypeptide
  MOD_RES (15)..(15): Atz(amino-PEG10)
  C-term Amide
DCLGFFRKCIPDNDXCCRPNLVCSRTHKWCKYVF

SEQ ID NO: 527 - protein, 34 aa, Artificial Sequence
  Description of Artificial Sequence: Synthetic polypeptide
  MOD_RES (12)..(12): Atz(amino-PEG10)
  MOD_RES (34)..(34): 1-Nal
  C-term Amide
DCLGFFRKCIPXNDKCCRPNLVCSRTHKWCKYVX

SEQ ID NO: 528 - protein, 35 aa, Ornithoctonus huwena
  C-term Amide
ECLEIFKACNPSNDQCCKSSKLVCSRKTRWCKYQI

SEQ ID NO: 529 - protein, 33 aa, Ornithoctonus huwena
ACKGVFDACTPGKNECCPNRVCSDKHKWCKWKL

SEQ ID NO: 530 - protein, 16 aa, Conus kinoshitai
  C-term Amide
CCNCSSKWCRDHSRCC

SEQ ID NO: 531 - protein, 30 aa, Thrixopelma pruriens
YCQKWMWTCDSERKCCEGMVCRLWCKKKLW

SEQ ID NO: 532 - protein, 35 aa, Artificial Sequence
  Description of Artificial Sequence: Synthetic polypeptide
  MOD_RES (1)..(1): Atz(amino-PEG10)
  C-term Amide
XDCLGFFRKCIPDNDKCCRPNLVCSRTHKWCKYVF

SEQ ID NO: 533 - protein, 34 aa, Artificial Sequence
  Description of Artificial Sequence: Synthetic polypeptide
  MOD_RES (1)..(1): Atz(amino-PEG10)
  C-term Amide
XCLGFFRKCIPDNDKCCRPNLVCSRTHKWCKYVF

SEQ ID NO: 534 - protein, 34 aa, Artificial Sequence
  Description of Artificial Sequence: Synthetic polypeptide
  MOD_RES (5)..(5): Atz(amino-PEG10)
  C-term Amide
DCLGXFRKCIPDNDKCCRPNLVCSRTHKWCKYVF

SEQ ID NO: 535 - protein, 34 aa, Artificial Sequence; identical to SEQ ID NO: 3
  Description of Artificial Sequence: Synthetic polypeptide
  MOD_RES (6)..(6): Atz(amino-PEG10)
  C-term Amide

SEQ ID NO: 536 - protein, 34 aa, Artificial Sequence
  Description of Artificial Sequence: Synthetic polypeptide
  MOD_RES (10)..(10): Atz(amino-PEG10)
  C-term Amide
DCLGFFRKCXPDNDKCCRPNLVCSRTHKWCKYVF

SEQ ID NO: 537 - protein, 34 aa, Artificial Sequence
  Description of Artificial Sequence: Synthetic polypeptide
  MOD_RES (11)..(11): Atz(amino-PEG10)
  C-term Amide
DCLGFFRKCIXDNDKCCRPNLVCSRTHKWCKYVF

SEQ ID NO: 538 - protein, 34 aa, Artificial Sequence
  Description of Artificial Sequence: Synthetic polypeptide
  MOD_RES (12)..(12): Atz(amino-PEG10)
  C-term Amide
DCLGFFRKCIPXNDKCCRPNLVCSRTHKWCKYVF

SEQ ID NO: 539 - protein, 34 aa, Artificial Sequence
  Description of Artificial Sequence: Synthetic polypeptide
  MOD_RES (20)..(20): Atz(amino-PEG10)
  C-term Amide
DCLGFFRKCIPDNDKCCRPXLVCSRTHKWCKYVF

SEQ ID NO: 540 - protein, 34 aa, Artificial Sequence
  Description of Artificial Sequence: Synthetic polypeptide
  MOD_RES (21)..(21): Atz(amino-PEG10)
  C-term Amide
DCLGFFRKCIPDNDKCCRPNXVCSRTHKWCKYVF

SEQ ID NO: 541 - protein, 34 aa, Artificial Sequence
  Description of Artificial Sequence: Synthetic polypeptide
  MOD_RES (24)..(24): Atz(amino-PEG10)
  C-term Amide
DCLGFFRKCIPDNDKCCRPNLVCXRTHKWCKYVF

SEQ ID NO: 542 - protein, 34 aa, Artificial Sequence
  Description of Artificial Sequence: Synthetic polypeptide
  MOD_RES (25)..(25): Atz(amino-PEG10)
  C-term Amide
DCLGFFRKCIPDNDKCCRPNLVCSXTHKWCKYVF

SEQ ID NO: 543 - protein, 34 aa, Artificial Sequence
  Description of Artificial Sequence: Synthetic polypeptide
  MOD_RES (26)..(26): Atz(amino-PEG10)
  C-term Amide
DCLGFFRKCIPDNDKCCRPNLVCSRXHKWCKYVF

SEQ ID NO: 544 - protein, 34 aa, Artificial Sequence
  Description of Artificial Sequence: Synthetic polypeptide
  MOD_RES (27)..(27): Atz(amino-PEG10)
  C-term Amide
DCLGFFRKCIPDNDKCCRPNLVCSRTXKWCKYVF

SEQ ID NO: 545 - protein, 34 aa, Artificial Sequence
  Description of Artificial Sequence: Synthetic polypeptide
  MOD_RES (28)..(28): Atz(amino-PEG10)
  C-term Amide
DCLGFFRKCIPDNDKCCRPNLVCSRTHXWCKYVF

SEQ ID NO: 546 - protein, 34 aa, Artificial Sequence
  Description of Artificial Sequence: Synthetic polypeptide
  MOD_RES (29)..(29): Atz(amino-PEG10)
  C-term Amide
DCLGFFRKCIPDNDKCCRPNLVCSRTHKXCKYVF

SEQ ID NO: 547 - protein, 34 aa, Artificial Sequence
  Description of Artificial Sequence: Synthetic polypeptide
  MOD_RES (32)..(32): Atz(amino-PEG10)
  C-term Amide
DCLGFFRKCIPDNDKCCRPNLVCSRTHKWCKXVF

SEQ ID NO: 548 - protein, 34 aa, Artificial Sequence
  Description of Artificial Sequence: Synthetic polypeptide
  MOD_RES (34)..(34): Atz(amino-PEG10)
  C-term Amide
DCLGFFRKCIPDNDKCCRPNLVCSRTHKWCKYVX

SEQ ID NO: 549 - protein, 35 aa, Artificial Sequence
  Description of Artificial Sequence: Synthetic polypeptide
  MOD_RES (35)..(35): Atz(amino-PEG10)
  C-term Amide
DCLGFFRKCIPDNDKCCRPNLVCSRTHKWCKYVFX

SEQ ID NO: 550 - protein, 35 aa, Artificial Sequence
  Description of Artificial Sequence: Synthetic polypeptide
  MOD_RES (1)..(1): Atz(amino-PEG10)
  MOD_RES (35)..(35): 1-Nal
  C-term Amide
XDCLGFFRKCIPDNDKCCRPNLVCSRTHKWCKYVX

SEQ ID NO: 551 - protein, 34 aa, Artificial Sequence
  Description of Artificial Sequence: Synthetic polypeptide
  MOD_RES (1)..(1): Atz(amino-PEG10)
  MOD_RES (34)..(34): 1-Nal
  C-term Amide
XCLGFFRKCIPDNDKCCRPNLVCSRTHKWCKYVX

SEQ ID NO: 552 - protein, 34 aa, Artificial Sequence
  Description of Artificial Sequence: Synthetic polypeptide
  MOD_RES (5)..(5): Atz(amino-PEG10)
  MOD_RES (34)..(34): 1-Nal
  C-term Amide
DCLGXFRKCIPDNDKCCRPNLVCSRTHKWCKYVX

SEQ ID NO: 553 - protein, 34 aa, Artificial Sequence
  Description of Artificial Sequence: Synthetic polypeptide
  MOD_RES (6)..(6): Atz(amino-PEG10)
  MOD_RES (34)..(34): 1-Nal
  C-term Amide
DCLGFXRKCIPDNDKCCRPNLVCSRTHKWCKYVX

SEQ ID NO: 554 - protein, 34 aa, Artificial Sequence
  Description of Artificial Sequence: Synthetic polypeptide
  MOD_RES (10)..(10): Atz(amino-PEG10)
  MOD_RES (34)..(34): 1-Nal
  C-term Amide
DCLGFFRKCXPDNDKCCRPNLVCSRTHKWCKYVX

SEQ ID NO: 555 - protein, 34 aa, Artificial Sequence
  Description of Artificial Sequence: Synthetic polypeptide
  MOD_RES (24)..(24): Atz(amino-PEG10)
  MOD_RES (34)..(34): 1-Nal
  C-term Amide
DCLGFFRKCIPDNDKCCRPNLVCXRTHKWCKYVX

SEQ ID NO: 556 - protein, 34 aa, Artificial Sequence
  Description of Artificial Sequence: Synthetic polypeptide
  MOD_RES (26)..(26): Atz(amino-PEG10)
  MOD_RES (34)..(34): 1-Nal
  C-term Amide
DCLGFFRKCIPDNDKCCRPNLVCSRXHKWCKYVX

SEQ ID NO: 557 - protein, 34 aa, Artificial Sequence
  Description of Artificial Sequence: Synthetic polypeptide
  MOD_RES (27)..(27): Atz(amino-PEG10)
  MOD_RES (34)..(34): 1-Nal
  C-term Amide
DCLGFFRKCIPDNDKCCRPNLVCSRTXKWCKYVX

SEQ ID NO: 558 - protein, 34 aa, Artificial Sequence
  Description of Artificial Sequence: Synthetic polypeptide
  MOD_RES (29)..(29): Atz(amino-PEG10)
  MOD_RES (34)..(34): 1-Nal
  C-term Amide
DCLGFFRKCIPDNDKCCRPNLVCSRTHKXCKYVX

SEQ ID NO: 559 - protein, 34 aa, Artificial Sequence
  Description of Artificial Sequence: Synthetic polypeptide
  MOD_RES (32)..(32): Atz(amino-PEG10)
  MOD_RES (34)..(34): 1-Nal
  C-term Amide
DCLGFFRKCIPDNDKCCRPNLVCSRTHKWCKXVX

SEQ ID NO: 560 - protein, 35 aa, Artificial Sequence
  Description of Artificial Sequence: Synthetic polypeptide
  MOD_RES (34)..(34): 1-Nal
  MOD_RES (35)..(35): Atz(amino-PEG10)
  C-term Amide
DCLGFFRKCIPDNDKCCRPNLVCSRTHKWCKYVXX

SEQ ID NO: 561 - protein, 34 aa, Artificial Sequence; identical to SEQ ID NO: 548
  Description of Artificial Sequence: Synthetic polypeptide
  MOD_RES (34)..(34): 1-Nal
  C-term Amide

SEQ ID NO: 562 - protein, 35 aa, Artificial Sequence
  Description of Artificial Sequence: Synthetic polypeptide
  MOD_RES (1)..(1): Atz(amino-PEG10)
  C-term Amide
XDCLGAFRKCIPDNDKCCRPNLVCSRTHKWCKYVF

SEQ ID NO: 563 - protein, 34 aa, Artificial Sequence
  Description of Artificial Sequence: Synthetic polypeptide
  MOD_RES (3)..(3): Atz(amino-PEG10)
  C-term Amide
DCXGAFRKCIPDNDKCCRPNLVCSRTHKWCKYVF

SEQ ID NO: 564 - protein, 34 aa, Artificial Sequence
  Description of Artificial Sequence: Synthetic polypeptide
  MOD_RES (4)..(4): Atz(amino-PEG10)
  C-term Amide
DCLXAFRKCIPDNDKCCRPNLVCSRTHKWCKYVF

SEQ ID NO: 565 - protein, 34 aa, Artificial Sequence; identical to SEQ ID NO: 256
  Description of Artificial Sequence: Synthetic polypeptide
  MOD_RES (6)..(6): Atz(amino-PEG10)
  C-term Amide

SEQ ID NO: 566 - protein, 34 aa, Artificial Sequence
  Description of Artificial Sequence: Synthetic polypeptide
  MOD_RES (7)..(7): Atz(amino-PEG10)
  C-term Amide
DCLGAFXKCIPDNDKCCRPNLVCSRTHKWCKYVF

SEQ ID NO: 567 - protein, 34 aa, Artificial Sequence
  Description of Artificial Sequence: Synthetic polypeptide
  MOD_RES (8)..(8): Atz(amino-PEG10)
  C-term Amide
DCLGAFRXCIPDNDKCCRPNLVCSRTHKWCKYVF

SEQ ID NO: 568 - protein, 34 aa, Artificial Sequence
  Description of Artificial Sequence: Synthetic polypeptide
  MOD_RES (10)..(10): Atz(amino-PEG10)
  C-term Amide
DCLGAFRKCXPDNDKCCRPNLVCSRTHKWCKYVF

SEQ ID NO: 569 - protein, 34 aa, Artificial Sequence
  Description of Artificial Sequence: Synthetic polypeptide
  MOD_RES (18)..(18): Atz(amino-PEG10)
  C-term Amide
DCLGAFRKCIPDNDKCCXPNLVCSRTHKWCKYVF

SEQ ID NO: 570 - protein, 34 aa, Artificial Sequence
  Description of Artificial Sequence: Synthetic polypeptide
  MOD_RES (19)..(19): Atz(amino-PEG10)
  C-term Amide
DCLGAFRKCIPDNDKCCRXNLVCSRTHKWCKYVF

SEQ ID NO: 571 - protein, 34 aa, Artificial Sequence
  Description of Artificial Sequence: Synthetic polypeptide
  MOD_RES (20)..(20): Atz(amino-PEG10)
  C-term Amide
DCLGAFRKCIPDNDKCCRPXLVCSRTHKWCKYVF

SEQ ID NO: 572 - protein, 34 aa, Artificial Sequence
  Description of Artificial Sequence: Synthetic polypeptide
  MOD_RES (21)..(21): Atz(amino-PEG10)
  C-term Amide
DCLGAFRKCIPDNDKCCRPNXVCSRTHKWCKYVF

SEQ ID NO: 573 - protein, 34 aa, Artificial Sequence
  Description of Artificial Sequence: Synthetic polypeptide
  MOD_RES (24)..(24): Atz(amino-PEG10)
  C-term Amide
DCLGAFRKCIPDNDKCCRPNLVCXRTHKWCKYVF

SEQ ID NO: 574 - protein, 34 aa, Artificial Sequence
  Description of Artificial Sequence: Synthetic polypeptide
  MOD_RES (25)..(25): Atz(amino-PEG10)
  C-term Amide
DCLGAFRKCIPDNDKCCRPNLVCSXTHKWCKYVF

SEQ ID NO: 575 - protein, 34 aa, Artificial Sequence
  Description of Artificial Sequence: Synthetic polypeptide
  MOD_RES (27)..(27): Atz(amino-PEG10)
  C-term Amide
DCLGAFRKCIPDNDKCCRPNLVCSRTXKWCKYVF

SEQ ID NO: 576 - protein, 34 aa, Artificial Sequence
  Description of Artificial Sequence: Synthetic polypeptide
  MOD_RES (28)..(28): Atz(amino-PEG10)
  C-term Amide
DCLGAFRKCIPDNDKCCRPNLVCSRTHXWCKYVF

SEQ ID NO: 577 - protein, 34 aa, Artificial Sequence
  Description of Artificial Sequence: Synthetic polypeptide
  MOD_RES (29)..(29): Atz(amino-PEG10)
  C-term Amide
DCLGAFRKCIPDNDKCCRPNLVCSRTHKXCKYVF

SEQ ID NO: 578 - protein, 34 aa, Artificial Sequence
  Description of Artificial Sequence: Synthetic polypeptide
  MOD_RES (32)..(32): Atz(amino-PEG10)
  C-term Amide
DCLGAFRKCIPDNDKCCRPNLVCSRTHKWCKXVF

SEQ ID NO: 579 - protein, 35 aa, Artificial Sequence
  Description of Artificial Sequence: Synthetic polypeptide
  MOD_RES (35)..(35): Atz(amino-PEG10)
  C-term Amide
DCLGAFRKCIPDNDKCCRPNLVCSRTHKWCKYVFX

SEQ ID NO: 580 - protein, 36 aa, Artificial Sequence
  Description of Artificial Sequence: Synthetic polypeptide
  MOD_RES (36)..(36): Atz(amino-PEG10)
  C-term Amide
DCLGAFRKCIPDNDKCCRPNLVCSRTHKWCKYVFWX

SEQ ID NO: 581 - protein, 34 aa, Artificial Sequence
  Description of Artificial Sequence: Synthetic polypeptide
  MOD_RES (1)..(1): Atz(amino-PEG10)
  C-term Amide
XCLGFFRKCIPDNDKCCRPNLVCSRLHKWCKYVF

SEQ ID NO: 582 - protein, 34 aa, Artificial Sequence
  Description of Artificial Sequence: Synthetic polypeptide
  MOD_RES (5)..(5): Atz(amino-PEG10)
  C-term Amide
DCLGXFRKCIPDNDKCCRPNLVCSRLHKWCKYVF

SEQ ID NO: 583 - protein, 34 aa, Artificial Sequence
  Description of Artificial Sequence: Synthetic polypeptide
  MOD_RES (6)..(6): Atz(amino-PEG10)
  C-term Amide
DCLGFXRKCIPDNDKCCRPNLVCSRLHKWCKYVF

SEQ ID NO: 584 - protein, 34 aa, Artificial Sequence
  Description of Artificial Sequence: Synthetic polypeptide
  MOD_RES (29)..(29): Atz(amino-PEG10)
  C-term Amide
DCLGFFRKCIPDNDKCCRPNLVCSRLHKXCKYVF

SEQ ID NO: 585 - protein, 34 aa, Artificial Sequence
  Description of Artificial Sequence: Synthetic polypeptide
  MOD_RES (32)..(32): Atz(amino-PEG10)
  C-term Amide
DCLGFFRKCIPDNDKCCRPNLVCSRLHKWCKXVF

SEQ ID NO: 586 - protein, 34 aa, Artificial Sequence
  Description of Artificial Sequence: Synthetic polypeptide
  MOD_RES (33)..(33): Atz(amino-PEG10)
  C-term Amide
DCLGFFRKCIPDNDKCCRPNLVCSRLHKWCKYXF

SEQ ID NO: 587 - protein, 34 aa, Artificial Sequence
  Description of Artificial Sequence: Synthetic polypeptide
  MOD_RES (34)..(34): Atz(amino-PEG10)
  C-term Amide
DCLGFFRKCIPDNDKCCRPNLVCSRLHKWCKYVX

SEQ ID NO: 588 - protein, 35 aa, Artificial Sequence
  Description of Artificial Sequence: Synthetic polypeptide
  MOD_RES (35)..(35): Atz(amino-PEG10)
  C-term Amide
DCLGFFRKCIPDNDKCCRPNLVCSRLHKWCKYVFX

SEQ ID NO: 589 - protein, 65 aa, Odontobuthus doriae
  C-term Amide
GVRDAYIADDKNCVYTCASNGYCNTECTKNGAESGYCQWIGRYGNACWCIKLPDEVPIRIPGKCR

SEQ ID NO: 590 - protein, 34 aa, Artificial Sequence; identical to SEQ ID NO: 515
  Description of Artificial Sequence: Synthetic polypeptide
  MOD_RES (13)..(13): Atz(20kDaPEG)
  C-term Amide

SEQ ID NO: 591 - protein, 34 aa, Artificial Sequence; identical to SEQ ID NO: 515
  Description of Artificial Sequence: Synthetic polypeptide
  MOD_RES (13)..(13): Atz
  C-term Amide

SEQ ID NO: 592 - skipped

SEQ ID NO: 593 - protein, 34 aa, Artificial Sequence; identical to SEQ ID NO: 545
  Description of Artificial Sequence: Synthetic polypeptide
  MOD_RES (28)..(28): Atz(20kDaPEG)
  C-term Amide

SEQ ID NO: 594 - protein, 34 aa, Artificial Sequence; identical to SEQ ID NO: 516
  Description of Artificial Sequence: Synthetic polypeptide
  MOD_RES (22)..(22): Atz(20kDaPEG)
  C-term Amide

SEQ ID NO: 595 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKECKYVF

SEQ ID NO: 596 - protein, 34 aa, Artificial Sequence; identical to SEQ ID NO: 105
  Description of Artificial Sequence: Synthetic polypeptide
  MOD_RES (5)..(5): 3Pal
  C-term Amide

SEQ ID NO: 597 - protein, 34 aa, Artificial Sequence
  Description of Artificial Sequence: Synthetic polypeptide
  C-term Free Acid
DCLGAFRKCIPDYDKCCRPNLVCSRTHRWCKYVF

SEQ ID NO: 598 - protein, 34 aa, Artificial Sequence
  Description of Artificial Sequence: Synthetic polypeptide
  C-term Free Acid
DCLGALRKCIPDNDKCCRPNLVCSRTHGWCKYVF

SEQ ID NO: 599 - protein, 34 aa, Artificial Sequence
  Description of Artificial Sequence: Synthetic polypeptide
  C-term Free Acid
DCLGALRKCIPDNDKCCRPNLVCSRTHHWCKYVF

SEQ ID NO: 600 - protein, 34 aa, Artificial Sequence
  Description of Artificial Sequence: Synthetic polypeptide
  C-term Free Acid
DCLGALRKCIPDNDKCCRPNLVCSRTHKWCKYVF

SEQ ID NO: 601 - protein, 34 aa, Artificial Sequence
  Description of Artificial Sequence: Synthetic polypeptide
  C-term Free Acid
DCLGALRKCIPDNDKCCRPNLVCSRTHNWCKYVF

SEQ ID NO: 602 - protein, 34 aa, Artificial Sequence; identical to SEQ ID NO: 257
  Description of Artificial Sequence: Synthetic polypeptide
  MOD_RES (5)..(5): D-amino acid
  C-term Amide

SEQ ID NO: 603 - protein, 34 aa, Artificial Sequence; identical to SEQ ID NO: 534
  Description of Artificial Sequence: Synthetic polypeptide
  MOD_RES (5)..(5): bAla
  C-term Amide

SEQ ID NO: 604 - protein, 34 aa, Artificial Sequence; identical to SEQ ID NO: 534
  Description of Artificial Sequence: Synthetic polypeptide
  MOD_RES (5)..(5): Aib
  C-term Amide

SEQ ID NO: 605 - protein, 34 aa, Artificial Sequence; identical to SEQ ID NO: 534
  Description of Artificial Sequence: Synthetic polypeptide
  MOD_RES (5)..(5): 2-Abu
  C-term Amide

SEQ ID NO: 606 - protein, 34 aa, Artificial Sequence; identical to SEQ ID NO: 534
  Description of Artificial Sequence: Synthetic polypeptide
  MOD_RES (5)..(5): Nva
  C-term Amide

SEQ ID NO: 607 - protein, 34 aa, Artificial Sequence; identical to SEQ ID NO: 534
  Description of Artificial Sequence: Synthetic polypeptide
  MOD_RES (5)..(5): Nle
  C-term Amide

SEQ ID NO: 608 - protein, 34 aa, Artificial Sequence; identical to SEQ ID NO: 534
  Description of Artificial Sequence: Synthetic polypeptide
  MOD_RES (5)..(5): OctylGly
  C-term Amide

SEQ ID NO: 609 - protein, 34 aa, Artificial Sequence; identical to SEQ ID NO: 534
  Description of Artificial Sequence: Synthetic polypeptide
  MOD_RES (5)..(5): Tle
  C-term Amide

SEQ ID NO: 610 - protein, 34 aa, Artificial Sequence; identical to SEQ ID NO: 534
  Description of Artificial Sequence: Synthetic polypeptide
  MOD_RES (5)..(5): hLeu
  C-term Amide

SEQ ID NO: 611 - protein, 34 aa, Artificial Sequence
  Description of Artificial Sequence: Synthetic polypeptide
  C-term Amide
DCLGMFRKCIPDNDKCCRPNLVCSRTHKWCKYVF

SEQ ID NO: 612 - protein, 34 aa, Artificial Sequence
  Description of Artificial Sequence: Synthetic polypeptide
  C-term Amide
DCLGLFRKCIPDNDKCCRPNLVCSRTHKWCKYVF

SEQ ID NO: 613 - protein, 34 aa, Artificial Sequence; identical to SEQ ID NO: 534
  Description of Artificial Sequence: Synthetic polypeptide
  MOD_RES (5)..(5): 3Pal
  C-term Amide

SEQ ID NO: 614 - protein, 34 aa, Artificial Sequence; identical to SEQ ID NO: 534
  Description of Artificial Sequence: Synthetic polypeptide
  MOD_RES (5)..(5): Thi
  C-term Amide

SEQ ID NO: 615 - protein, 34 aa, Artificial Sequence; identical to SEQ ID NO: 534
  Description of Artificial Sequence: Synthetic polypeptide
  MOD_RES (5)..(5): Cpg
  C-term Amide

SEQ ID NO: 616 - protein, 34 aa, Artificial Sequence; identical to SEQ ID NO: 534
  Description of Artificial Sequence: Synthetic polypeptide
  MOD_RES (5)..(5): Chg
  C-term Amide

SEQ ID NO: 617 - protein, 34 aa, Artificial Sequence
  Description of Artificial Sequence: Synthetic polypeptide
  C-term Amide
DCLGSFRKCIPDNDKCCRPNLVCSRTHKWCKYVF

SEQ ID NO: 618 - protein, 34 aa, Artificial Sequence
  Description of Artificial Sequence: Synthetic polypeptide
  C-term Amide
DCLGVFRKCIPDNDKCCRPNLVCSRTHKWCKYVF

SEQ ID NO: 619 - protein, 34 aa, Artificial Sequence; identical to SEQ ID NO: 534
  Description of Artificial Sequence: Synthetic polypeptide
  MOD_RES (5)..(5): 4-Bz-Phe
  C-term Amide

SEQ ID NO: 620 - protein, 34 aa, Artificial Sequence; identical to SEQ ID NO: 534
  Description of Artificial Sequence: Synthetic polypeptide
  MOD_RES (5)..(5): DiMeO-Phe
  C-term Amide

SEQ ID NO: 621 - protein, 34 aa, Artificial Sequence; identical to SEQ ID NO: 534
  Description of Artificial Sequence: Synthetic polypeptide
  MOD_RES (5)..(5): DiCl-Phe
  C-term Amide

SEQ ID NO: 622 - protein, 34 aa, Artificial Sequence; identical to SEQ ID NO: 534
  Description of Artificial Sequence: Synthetic polypeptide
  MOD_RES (5)..(5): pI-Phe
  C-term Amide

SEQ ID NO: 623 - protein, 34 aa, Artificial Sequence; identical to SEQ ID NO: 534
  Description of Artificial Sequence: Synthetic polypeptide
  MOD_RES (5)..(5): 4CF3-Phe
  C-term Amide

SEQ ID NO: 624 - protein, 34 aa, Artificial Sequence; identical to SEQ ID NO: 534
  Description of Artificial Sequence: Synthetic polypeptide
  MOD_RES (5)..(5): 4-F-Phe
  C-term Amide

SEQ ID NO: 625 - protein, 34 aa, Artificial Sequence; identical to SEQ ID NO: 534
  Description of Artificial Sequence: Synthetic polypeptide
  MOD_RES (5)..(5): 4-Me-Phe
  C-term Amide

SEQ ID NO: 626 - protein, 34 aa, Artificial Sequence; identical to SEQ ID NO: 534
  Description of Artificial Sequence: Synthetic polypeptide
  MOD_RES (5)..(5): 4tBu-Phe
  C-term Amide

SEQ ID NO: 627 - protein, 34 aa, Artificial Sequence; identical to SEQ ID NO: 534
  Description of Artificial Sequence: Synthetic polypeptide
  MOD_RES (5)..(5): NMeVal
  C-term Amide

SEQ ID NO: 628 - protein, 34 aa, Artificial Sequence; identical to SEQ ID NO: 534
  Description of Artificial Sequence: Synthetic polypeptide
  MOD_RES (5)..(5): NMeLeu
  C-term Amide

SEQ ID NO: 629 - protein, 34 aa, Artificial Sequence; identical to SEQ ID NO: 534
  Description of Artificial Sequence: Synthetic polypeptide
  MOD_RES (5)..(5): NMePhe
  C-term Amide

SEQ ID NO: 630 - protein, 34 aa, Artificial Sequence; identical to SEQ ID NO: 534
  Description of Artificial Sequence: Synthetic polypeptide
  MOD_RES (5)..(5): 2-Cl-Phe
  C-term Amide

SEQ ID NO: 631 - protein, 34 aa, Artificial Sequence; identical to SEQ ID NO: 534
  Description of Artificial Sequence: Synthetic polypeptide
  MOD_RES (5)..(5): hPhe
  C-term Amide

SEQ ID NO: 632 - protein, 34 aa, Artificial Sequence; identical to SEQ ID NO: 534
  Description of Artificial Sequence: Synthetic polypeptide
  MOD_RES (5)..(5): Sar
  C-term Amide

SEQ ID NO: 633 - protein, 34 aa, Artificial Sequence; identical to SEQ ID NO: 600
  Description of Artificial Sequence: Synthetic polypeptide
  MOD_RES (5)..(5): D-amino acid
  C-term Amide

SEQ ID NO: 634 - protein, 34 aa, Artificial Sequence
  Description of Artificial Sequence: Synthetic polypeptide
  MOD_RES (5)..(5): bAla
  C-term Amide
DCLGXLRKCIPDNDKCCRPNLVCSRTHKWCKYVF

SEQ ID NO: 635 - protein, 34 aa, Artificial Sequence; identical to SEQ ID NO: 634
  Description of Artificial Sequence: Synthetic polypeptide
  MOD_RES (5)..(5): Aib
  C-term Amide

SEQ ID NO: 636 - protein, 34 aa, Artificial Sequence; identical to SEQ ID NO: 634
  Description of Artificial Sequence: Synthetic polypeptide
  MOD_RES (5)..(5): 2-Abu
  C-term Amide

SEQ ID NO: 637 - protein, 34 aa, Artificial Sequence; identical to SEQ ID NO: 634
  Description of Artificial Sequence: Synthetic polypeptide
  MOD_RES (5)..(5): Nva
  C-term Amide

SEQ ID NO: 638 - protein, 34 aa, Artificial Sequence; identical to SEQ ID NO: 634
  Description of Artificial Sequence: Synthetic polypeptide
  MOD_RES (5)..(5): Nle
  C-term Amide

SEQ ID NO: 639 - protein, 34 aa, Artificial Sequence; identical to SEQ ID NO: 634
  Description of Artificial Sequence: Synthetic polypeptide
  MOD_RES (5)..(5): OctylGly
  C-term Amide

SEQ ID NO: 640 - protein, 34 aa, Artificial Sequence
  Description of Artificial Sequence: Synthetic polypeptide
  MOD_RES (13)..(13): Pra
  C-term Amide
DCLGAFRKCIPDXDKCCRPNLVCSRLHRWCKYVF

SEQ ID NO: 641 - protein, 34 aa, Artificial Sequence
  Description of Artificial Sequence: Synthetic polypeptide
  C-term Amide
DCLGMLRKCIPDNDKCCRPNLVCSRTHKWCKYVF

SEQ ID NO: 642 - protein, 34 aa, Artificial Sequence; identical to SEQ ID NO: 634
  Description of Artificial Sequence: Synthetic polypeptide
  MOD_RES (5)..(5): 3Pal
  C-term Amide

SEQ ID NO: 643 - protein, 34 aa, Artificial Sequence
  Description of Artificial Sequence: Synthetic polypeptide
  C-term Amide
DCLGSLRKCIPDNDKCCRPNLVCSRTHKWCKYVF

SEQ ID NO: 644 - protein, 34 aa, Artificial Sequence
  Description of Artificial Sequence: Synthetic polypeptide
  C-term Amide
DCLGVLRKCIPDNDKCCRPNLVCSRTHKWCKYVF

SEQ ID NO: 645 - protein, 34 aa, Artificial Sequence; identical to SEQ ID NO: 634
  Description of Artificial Sequence: Synthetic polypeptide
  MOD_RES (5)..(5): DiMeO-Phe
  C-term Amide

SEQ ID NO: 646 - protein, 34 aa, Artificial Sequence; identical to SEQ ID NO: 634
  Description of Artificial Sequence: Synthetic polypeptide
  MOD_RES (5)..(5): Sar
  C-term Amide

SEQ ID NO: 647 - protein, 34 aa, Artificial Sequence; identical to SEQ ID NO: 22
  Description of Artificial Sequence: Synthetic polypeptide
  MOD_RES (5)..(5): D-amino acid
  C-term Amide

SEQ ID NO: 648 - protein, 34 aa, Artificial Sequence; identical to SEQ ID NO: 105
  Description of Artificial Sequence: Synthetic polypeptide
  MOD_RES (5)..(5): bAla
  C-term Amide

SEQ ID NO: 649 - protein, 34 aa, Artificial Sequence; identical to SEQ ID NO: 105
  Description of Artificial Sequence: Synthetic polypeptide
  MOD_RES (5)..(5): 2-Abu
  C-term Amide

SEQ ID NO: 650 - protein, 34 aa, Artificial Sequence; identical to SEQ ID NO: 105
  Description of Artificial Sequence: Synthetic polypeptide
  MOD_RES (5)..(5): Nva
  C-term Amide

SEQ ID NO: 651 - protein, 34 aa, Artificial Sequence; identical to SEQ ID NO: 105
  Description of Artificial Sequence: Synthetic polypeptide
  MOD_RES (5)..(5): Nle
  C-term Amide

SEQ ID NO: 652 - protein, 34 aa, Artificial Sequence; identical to SEQ ID NO: 105
  Description of Artificial Sequence: Synthetic polypeptide
  MOD_RES (5)..(5): DiMeO-Phe
  C-term Amide

SEQ ID NO: 653 - protein, 34 aa, Artificial Sequence; identical to SEQ ID NO: 105
  Description of Artificial Sequence: Synthetic polypeptide
  MOD_RES (5)..(5): DiCl-Phe
  C-term Amide

SEQ ID NO: 654 - protein, 34 aa, Artificial Sequence; identical to SEQ ID NO: 105
  Description of Artificial Sequence: Synthetic polypeptide
  MOD_RES (5)..(5): 4CF3-Phe
  C-term Amide

SEQ ID NO: 655 - protein, 34 aa, Artificial Sequence; identical to SEQ ID NO: 105
  Description of Artificial Sequence: Synthetic polypeptide
  MOD_RES (5)..(5): 4-F-Phe
  C-term Amide

SEQ ID NO: 656 - protein, 34 aa, Artificial Sequence; identical to SEQ ID NO: 105
  Description of Artificial Sequence: Synthetic polypeptide
  MOD_RES (5)..(5): NMeVal
  C-term Amide

SEQ ID NO: 657 - protein, 34 aa, Artificial Sequence; identical to SEQ ID NO: 105
  Description of Artificial Sequence: Synthetic polypeptide
  MOD_RES (5)..(5): NMePhe
  C-term Amide

SEQ ID NO: 658 - protein, 34 aa, Artificial Sequence; identical to SEQ ID NO: 105
  Description of Artificial Sequence: Synthetic polypeptide
  MOD_RES (5)..(5): Sar
  C-term Amide

SEQ ID NO: 659 - protein, 34 aa, Artificial Sequence; identical to SEQ ID NO: 634
  Description of Artificial Sequence: Synthetic polypeptide
  MOD_RES (5)..(5): Tle
  C-term Amide

SEQ ID NO: 660 - protein, 34 aa, Artificial Sequence; identical to SEQ ID NO: 634
  Description of Artificial Sequence: Synthetic polypeptide
  MOD_RES (5)..(5): hLeu
  C-term Amide

SEQ ID NO: 661 - protein, 34 aa, Artificial Sequence
  Description of Artificial Sequence: Synthetic polypeptide
  C-term Amide
DCLGLLRKCIPDNDKCCRPNLVCSRTHKWCKYVF

SEQ ID NO: 662 - protein, 34 aa, Artificial Sequence; identical to SEQ ID NO: 634
  Description of Artificial Sequence: Synthetic polypeptide
  MOD_RES (5)..(5): Thi
  C-term Amide

SEQ ID NO: 663 - protein, 34 aa, Artificial Sequence; identical to SEQ ID NO: 634
  Description of Artificial Sequence: Synthetic polypeptide
  MOD_RES (5)..(5): Cpg
  C-term Amide

SEQ ID NO: 664 - protein, 34 aa, Artificial Sequence; identical to SEQ ID NO: 634
  Description of Artificial Sequence: Synthetic polypeptide
  MOD_RES (5)..(5): Chg
  C-term Amide

SEQ ID NO: 665 - protein, 34 aa, Artificial Sequence; identical to SEQ ID NO: 634
  Description of Artificial Sequence: Synthetic polypeptide
  MOD_RES (5)..(5): 4-Bz-Phe
  C-term Amide

SEQ ID NO: 666 - protein, 34 aa, Artificial Sequence; identical to SEQ ID NO: 634
  Description of Artificial Sequence: Synthetic polypeptide
  MOD_RES (5)..(5): DiCl-Phe
  C-term Amide

SEQ ID NO: 667 - protein, 34 aa, Artificial Sequence; identical to SEQ ID NO: 634
  Description of Artificial Sequence: Synthetic polypeptide
  MOD_RES (5)..(5): pI-Phe
  C-term Amide

SEQ ID NO: 668 - protein, 34 aa, Artificial Sequence; identical to SEQ ID NO: 634
  Description of Artificial Sequence: Synthetic polypeptide
  MOD_RES (5)..(5): 4CF3-Phe
  C-term Amide

SEQ ID NO: 669 - protein, 34 aa, Artificial Sequence; identical to SEQ ID NO: 634
  Description of Artificial Sequence: Synthetic polypeptide
  MOD_RES (5)..(5): 4-F-Phe
  C-term Amide

SEQ ID NO: 670 - protein, 34 aa, Artificial Sequence; identical to SEQ ID NO: 634
  Description of Artificial Sequence: Synthetic polypeptide
  MOD_RES (5)..(5): 4-Me-Phe
  C-term Amide

SEQ ID NO: 671 - protein, 34 aa, Artificial Sequence; identical to SEQ ID NO: 634
  Description of Artificial Sequence: Synthetic polypeptide
  MOD_RES (5)..(5): 4tBu-Phe
  C-term Amide

SEQ ID NO: 672 - protein, 34 aa, Artificial Sequence; identical to SEQ ID NO: 634
  Description of Artificial Sequence: Synthetic polypeptide
  MOD_RES (5)..(5): NMeVal
  C-term Amide

SEQ ID NO: 673 - protein, 34 aa, Artificial Sequence; identical to SEQ ID NO: 634
  Description of Artificial Sequence: Synthetic polypeptide
  MOD_RES (5)..(5): NMeLeu
  C-term Amide

SEQ ID NO: 674 - protein, 34 aa, Artificial Sequence; identical to SEQ ID NO: 634
  Description of Artificial Sequence: Synthetic polypeptide
  MOD_RES (5)..(5): NMePhe
  C-term Amide

SEQ ID NO: 675 - protein, 34 aa, Artificial Sequence; identical to SEQ ID NO: 634
  Description of Artificial Sequence: Synthetic polypeptide
  MOD_RES (5)..(5): 2-Cl-Phe
  C-term Amide

SEQ ID NO: 676 - protein, 34 aa, Artificial Sequence; identical to SEQ ID NO: 634
  Description of Artificial Sequence: Synthetic polypeptide
  MOD_RES (5)..(5): hPhe
  C-term Amide

SEQ ID NO: 677 - protein, 34 aa, Artificial Sequence; identical to SEQ ID NO: 105
  Description of Artificial Sequence: Synthetic polypeptide
  MOD_RES (5)..(5): OctylGly
  C-term Amide

SEQ ID NO: 678 - protein, 34 aa, Artificial Sequence; identical to SEQ ID NO: 105
  Description of Artificial Sequence: Synthetic polypeptide
  MOD_RES (5)..(5): Tle
  C-term Amide

SEQ ID NO: 679 - protein, 34 aa, Artificial Sequence; identical to SEQ ID NO: 105
  Description of Artificial Sequence: Synthetic polypeptide
  MOD_RES (5)..(5): hLeu
  C-term Amide

SEQ ID NO: 680 - protein, 34 aa, Artificial Sequence; identical to SEQ ID NO: 534
  Description of Artificial Sequence: Synthetic polypeptide
  MOD_RES (5)..(5): Cha
  C-term Amide

SEQ ID NO: 681 - protein, 34 aa, Artificial Sequence; identical to SEQ ID NO: 634
  Description of Artificial Sequence: Synthetic polypeptide
  MOD_RES (5)..(5): Cha
  C-term Amide

SEQ ID NO: 682 - protein, 34 aa, Artificial Sequence; identical to SEQ ID NO: 105
  Description of Artificial Sequence: Synthetic polypeptide
  MOD_RES (5)..(5): Thi
  C-term Amide

SEQ ID NO: 683 - protein, 34 aa, Artificial Sequence; identical to SEQ ID NO: 105
  Description of Artificial Sequence: Synthetic polypeptide
  MOD_RES (5)..(5): Cpg
  C-term Amide

SEQ ID NO: 684 - protein, 34 aa, Artificial Sequence; identical to SEQ ID NO: 105
  Description of Artificial Sequence: Synthetic polypeptide
  MOD_RES (5)..(5): Chg
  C-term Amide

SEQ ID NO: 685 - protein, 34 aa, Artificial Sequence; identical to SEQ ID NO: 105
  Description of Artificial Sequence: Synthetic polypeptide
  MOD_RES (5)..(5): 4-Bz-Phe
  C-term Amide

SEQ ID NO: 686 - protein, 34 aa, Artificial Sequence; identical to SEQ ID NO: 105
  Description of Artificial Sequence: Synthetic polypeptide
  MOD_RES (5)..(5): 4-Me-Phe
  C-term Amide

SEQ ID NO: 687 - protein, 34 aa, Artificial Sequence; identical to SEQ ID NO: 105
  Description of Artificial Sequence: Synthetic polypeptide
  MOD_RES (5)..(5): 4tBu-Phe
  C-term Amide

SEQ ID NO: 688 - protein, 34 aa, Artificial Sequence; identical to SEQ ID NO: 105
  Description of Artificial Sequence: Synthetic polypeptide
  MOD_RES (5)..(5): NMeLeu
  C-term Amide

SEQ ID NO: 689 - protein, 34 aa, Artificial Sequence; identical to SEQ ID NO: 105
  Description of Artificial Sequence: Synthetic polypeptide
  MOD_RES (5)..(5): 2-Cl-Phe
  C-term Amide

SEQ ID NO: 690 - protein, 34 aa, Artificial Sequence; identical to SEQ ID NO: 105
  Description of Artificial Sequence: Synthetic polypeptide
  MOD_RES (5)..(5): hPhe
  C-term Amide

SEQ ID NO: 691 - protein, 34 aa, Artificial Sequence; identical to SEQ ID NO: 435
  Description of Artificial Sequence: Synthetic polypeptide
  C-term Amide

SEQ ID NO: 692 - protein, 34 aa, Artificial Sequence; identical to SEQ ID NO: 254
  Description of Artificial Sequence: Synthetic polypeptide
  MOD_RES (32)..(32): 1'NMeTrp
  C-term Amide

SEQ ID NO: 693 - protein, 34 aa, Artificial Sequence
  Description of Artificial Sequence: Synthetic polypeptide
  MOD_RES (32)..(32): 1'NMeTrp
  C-term Amide
DCLGMMRKCIPDNDKCCRPNLVCSRTHKWCKXVF

SEQ ID NO: 694 - protein, 34 aa, Artificial Sequence
  Description of Artificial Sequence: Synthetic polypeptide
  C-term Amide
DCLRMMRKCIPDNDKCCRPNLVCSRTHKWCKYVF

SEQ ID NO: 695 - protein, 34 aa, Artificial Sequence
  Description of Artificial Sequence: Synthetic polypeptide
  MOD_RES (32)..(32): 1'NMeTrp
  C-term Amide
DCLGFMRKCIPDNDKCCRSNLVCSRTHKWCKXVF

SEQ ID NO: 696 - protein, 34 aa, Artificial Sequence; identical to SEQ ID NO: 600
  Description of Artificial Sequence: Synthetic polypeptide
  C-term Amide

SEQ ID NO: 697 - protein, 34 aa, Artificial Sequence
  Description of Artificial Sequence: Synthetic polypeptide
  C-term Amide
DCLGAGRKCIPDNDKCCRPNLVCSRTHKWCKYVF

SEQ ID NO: 698 - protein, 34 aa, Artificial Sequence
  Description of Artificial Sequence: Synthetic polypeptide
  C-term Amide
DCLGAYRKCIPDNDKCCRPNLVCSRTHKWCKYVF

SEQ ID NO: 699 - protein, 34 aa, Artificial Sequence; identical to SEQ ID NO: 256
  Description of Artificial Sequence: Synthetic polypeptide
  MOD_RES (6)..(6): 1'NMeTrp
  C-term Amide

SEQ ID NO: 700 - protein, 34 aa, Artificial Sequence
  Description of Artificial Sequence: Synthetic polypeptide
  C-term Amide
DCLGAMRKCDPDNDKCCRPNLVCSRTHKWCKYVF

SEQ ID NO: 701 - protein, 34 aa, Artificial Sequence
  Description of Artificial Sequence: Synthetic polypeptide
  C-term Amide
DCLGAMRKCDPENDKCCRPNLVCSRTHKWCKYVF

SEQ ID NO: 702 - protein, 34 aa, Artificial Sequence
  Description of Artificial Sequence: Synthetic polypeptide
  C-term Amide
DCLGAFRKCDPDNDKCCRPNLVCSRTHKWCKYVF

SEQ ID NO: 703 - protein, 34 aa, Artificial Sequence
  Description of Artificial Sequence: Synthetic polypeptide
  C-term Amide
DCLGAFRKCIPENDKCCRPNLVCSRTHKWCKYVF

SEQ ID NO: 704 - protein, 34 aa, Artificial Sequence
  Description of Artificial Sequence: Synthetic polypeptide
  C-term Amide
DCLGVMRKCIPDNDKCCRPNLVCSRTHEWCKYVF

SEQ ID NO: 705 - protein, 34 aa, Artificial Sequence
  Description of Artificial Sequence: Synthetic polypeptide
  MOD_RES (5)..(5): Nva
  C-term Amide
DCLGXMRKCIPDNDKCCRPNLVCSRTHEWCKYVF

SEQ ID NO: 706 - protein, 34 aa, Artificial Sequence; identical to SEQ ID NO: 705
  Description of Artificial Sequence: Synthetic polypeptide
  MOD_RES (5)..(5): 2-Abu
  C-term Amide

SEQ ID NO: 707 - protein, 34 aa, Artificial Sequence
  Description of Artificial Sequence: Synthetic polypeptide
  MOD_RES (5)..(5): 2-Abu
  C-term Amide
DCLGXLRKCIPDNDKCCRPNLVCSRTHEWCKYVF

SEQ ID NO: 708 - protein, 34 aa, Artificial Sequence; identical to SEQ ID NO: 707
  Description of Artificial Sequence: Synthetic polypeptide
  MOD_RES (5)..(5): Nva
  C-term Amide

SEQ ID NO: 709 - protein, 34 aa, Artificial Sequence
  Description of Artificial Sequence: Synthetic polypeptide
  C-term Amide
DCLGVLRKCIPDNDKCCRPNLVCSRTHEWCKYVF

SEQ ID NO: 710 - protein, 34 aa, Artificial Sequence
  Description of Artificial Sequence: Synthetic polypeptide
  C-term Amide
DCLGVMRKCDPDNDKCCRPNLVCSRTHKWCKYVF

SEQ ID NO: 711 - protein, 34 aa, Artificial Sequence
  Description of Artificial Sequence: Synthetic polypeptide
  C-term Amide
DCLGVMRKCIPENDKCCRPNLVCSRTHKWCKYVF

SEQ ID NO: 712 - protein, 34 aa, Artificial Sequence
  Description of Artificial Sequence: Synthetic polypeptide
  C-term Amide
DCLGVMRKCDPENDKCCRPNLVCSRTHKWCKYVF

SEQ ID NO: 713 - protein, 34 aa, Artificial Sequence
  Description of Artificial Sequence: Synthetic polypeptide
  MOD_RES (25)..(25): Cit
  C-term Amide
DCLGVMRKCIPDNDKCCRPNLVCSXTHKWCKYVF

SEQ ID NO: 714 - protein, 34 aa, Artificial Sequence
  Description of Artificial Sequence: Synthetic polypeptide
  C-term Amide
DCLGTMRKCDPDNDKCCRPNLVCSRTHKWCKYVF

SEQ ID NO: 715 - protein, 34 aa, Artificial Sequence
  Description of Artificial Sequence: Synthetic polypeptide
  C-term Amide
DCLGAMRKCIPDNDKCCRPNLVCSRTHGWCKYVF

SEQ ID NO: 716 - protein, 34 aa, Artificial Sequence
  Description of Artificial Sequence: Synthetic polypeptide
  MOD_RES (2)..(2): 2-Abu
  MOD_RES (17)..(17): 2-Abu
  C-term Amide
DXLGAMRKCDPDNDKCXRPNLVCSRTHKWCKYVF

SEQ ID NO: 717 - protein, 34 aa, Artificial Sequence
  Description of Artificial Sequence: Synthetic polypeptide
  MOD_RES (2)..(2): 2-Abu
  MOD_RES (5)..(5): Nva
  MOD_RES (17)..(17): 2-Abu
  C-term Amide
DXLGXLRKCIPDNDKCXRPNLVCSRTHEWCKYVF

SEQ ID NO: 718 - protein, 34 aa, Artificial Sequence; identical to SEQ ID NO: 717
  Description of Artificial Sequence: Synthetic polypeptide
  MOD_RES (2)..(2): 2-Abu
  MOD_RES (5)..(5): 2-Abu
  MOD_RES (17)..(17): 2-Abu
  C-term Amide

SEQ ID NO: 719 - protein, 34 aa, Artificial Sequence
  Description of Artificial Sequence: Synthetic polypeptide
  MOD_RES (2)..(2): 2-Abu
  MOD_RES (17)..(17): 2-Abu
  C-term Amide
DXLGALRKCIPDNDKCXRPNLVCSRTHEWCKYVF

SEQ ID NO: 720 - protein, 34 aa, Artificial Sequence
  Description of Artificial Sequence: Synthetic polypeptide
  MOD_RES (2)..(2): 2-Abu
  MOD_RES (17)..(17): 2-Abu
  C-term Amide
DXLGVLRKCIPDNDKCXRPNLVCSRTHEWCKYVF

SEQ ID NO: 721 - protein, 34 aa, Artificial Sequence; identical to SEQ ID NO: 256
  Description of Artificial Sequence: Synthetic polypeptide
  MOD_RES (6)..(6): Nle
  C-term Amide

SEQ ID NO: 722 - protein, 34 aa, Artificial Sequence
  Description of Artificial Sequence: Synthetic polypeptide
  MOD_RES (6)..(6): Nle
  C-term Amide
DCLGAXRKCEPDNDKCCRPNLVCSRTHKWCKYVF

SEQ ID NO: 723 - protein, 34 aa, Artificial Sequence
  Description of Artificial Sequence: Synthetic polypeptide
  C-term Amide
DCLGALRKCEPDNDKCCRPNLVCSRTHKWCKYVF

SEQ ID NO: 724 - protein, 34 aa, Artificial Sequence
  Description of Artificial Sequence: Synthetic polypeptide
  C-term Amide
DCLGAFRKCEPDNDKCCRPNLVCSRTHKWCKYVF

SEQ ID NO: 725 - protein, 34 aa, Artificial Sequence
  Description of Artificial Sequence: Synthetic polypeptide
  MOD_RES (6)..(6): Nle
  C-term Amide
DCLGAXRKCIPENDKCCRPNLVCSRTHKWCKYVF

SEQ ID NO: 726 - protein, 34 aa, Artificial Sequence
  Description of Artificial Sequence: Synthetic polypeptide
  C-term Amide
DCLGALRKCIPENDKCCRPNLVCSRTHKWCKYVF

SEQ ID NO: 727 - protein, 34 aa, Artificial Sequence
  Description of Artificial Sequence: Synthetic polypeptide
  MOD_RES (6)..(6): Nle
  C-term Amide
DCLGAXRKCIPDNDKCCRPNLVCSRTHEWCKYVF

SEQ ID NO: 728 - protein, 34 aa, Artificial Sequence
  Description of Artificial Sequence: Synthetic polypeptide
  C-term Amide
DCLGALRKCIPDNDKCCRPNLVCSRTHEWCKYVF

SEQ ID NO: 729 - protein, 34 aa, Artificial Sequence
  Description of Artificial Sequence: Synthetic polypeptide
  C-term Amide
DCLGAFRKCIPDNDKCCRPNLVCSRTHEWCKYVF

SEQ ID NO: 730 - protein, 34 aa, Artificial Sequence
  Description of Artificial Sequence: Synthetic polypeptide
  MOD_RES (6)..(6): Nle
  C-term Amide
DCLGAXRKCIPDNDKCCRPNLVCSATHKWCKYVF

SEQ ID NO: 731 - protein, 34 aa, Artificial Sequence
  Description of Artificial Sequence: Synthetic polypeptide
  C-term Amide
DCLGALRKCIPDNDKCCRPNLVCSATHKWCKYVF

SEQ ID NO: 732 - protein, 34 aa, Artificial Sequence
  Description of Artificial Sequence: Synthetic polypeptide
  C-term Amide
DCLGAFRKCIPDNDKCCRPNLVCSATHKWCKYVF

SEQ ID NO: 733 - protein, 34 aa, Artificial Sequence
  Description of Artificial Sequence: Synthetic polypeptide
  MOD_RES (6)..(6): Nle
  C-term Amide
DCLGAXRKCIPDNDKCCRPNLVCSETHKWCKYVF

SEQ ID NO: 734 - protein, 34 aa, Artificial Sequence
  Description of Artificial Sequence: Synthetic polypeptide
  C-term Amide
DCLGALRKCIPDNDKCCRPNLVCSETHKWCKYVF

SEQ ID NO: 735 - protein, 34 aa, Artificial Sequence
  Description of Artificial Sequence: Synthetic polypeptide
  C-term Amide
DCLGAFRKCIPDNDKCCRPNLVCSETHKWCKYVF

SEQ ID NO: 736 - protein, 34 aa, Artificial Sequence; identical to SEQ ID NO: 526
  Description of Artificial Sequence: Synthetic polypeptide
  MOD_RES (15)..(15): Pra
  C-term Amide

SEQ ID NO: 737 - protein, 34 aa, Artificial Sequence
  Description of Artificial Sequence: Synthetic polypeptide
  C-term Amide
DCLGAMRKCIPDNDKCCRPNLVCSRTHHWCKYVF

SEQ ID NO: 738 - protein, 34 aa, Artificial Sequence
  Description of Artificial Sequence: Synthetic polypeptide
  C-term Amide
DCLGAMRKCIPDNDKCCRPNLVCSRTHSWCKYVF

SEQ ID NO: 739 - protein, 34 aa, Artificial Sequence
  Description of Artificial Sequence: Synthetic polypeptide
  C-term Amide
DCLGAMRKCIPDNDKCCRPNLVCSRTHQWCKYVF

SEQ ID NO: 740 - protein, 34 aa, Artificial Sequence
  Description of Artificial Sequence: Synthetic polypeptide
  MOD_RES (28)..(28): 3Pal
  C-term Amide
DCLGAMRKCIPDNDKCCRPNLVCSRTHXWCKYVF

SEQ ID NO: 741 - protein, 34 aa, Artificial Sequence; identical to SEQ ID NO: 740
  Description of Artificial Sequence: Synthetic polypeptide
  MOD_RES (28)..(28): 4-aminoPhe
  C-term Amide

SEQ ID NO: 742 - protein, 34 aa, Artificial Sequence; identical to SEQ ID NO: 740
  Description of Artificial Sequence: Synthetic polypeptide
  MOD_RES (28)..(28): Lys(Ac)
  C-term Amide

SEQ ID NO: 743 - protein, 34 aa, Artificial Sequence; identical to SEQ ID NO: 740
  Description of Artificial Sequence: Synthetic polypeptide
  MOD_RES (28)..(28): SDMArg
  C-term Amide

SEQ ID NO: 744 - protein, 34 aa, Artificial Sequence; identical to SEQ ID NO: 740
  Description of Artificial Sequence: Synthetic polypeptide
  MOD_RES (28)..(28): hArg
  C-term Amide

SEQ ID NO: 745 - protein, 34 aa, Artificial Sequence; identical to SEQ ID NO: 740
  Description of Artificial Sequence: Synthetic polypeptide
  MOD_RES (28)..(28): Arg(Me)
  C-term Amide

SEQ ID NO: 746 - protein, 34 aa, Artificial Sequence; identical to SEQ ID NO: 740
  Description of Artificial Sequence: Synthetic polypeptide
  MOD_RES (28)..(28): Orn
  C-term Amide

SEQ ID NO: 747 - protein, 34 aa, Artificial Sequence; identical to SEQ ID NO: 740
  Description of Artificial Sequence: Synthetic polypeptide
  MOD_RES (28)..(28): Dap
  C-term Amide

SEQ ID NO: 748 - protein, 34 aa, Artificial Sequence; identical to SEQ ID NO: 740
  Description of Artificial Sequence: Synthetic polypeptide
  MOD_RES (28)..(28): Cit
  C-term Amide

SEQ ID NO: 749 - protein, 34 aa, Artificial Sequence; identical to SEQ ID NO: 740
  Description of Artificial Sequence: Synthetic polypeptide
  MOD_RES (28)..(28): HCit
  C-term Amide

SEQ ID NO: 750 - protein, 34 aa, Artificial Sequence
  Description of Artificial Sequence: Synthetic polypeptide
  C-term Amide
DCLGFMRKCIPDNDKCCRPNLVCSRTHDWCKYVF

SEQ ID NO: 751 - protein, 34 aa, Artificial Sequence
  Description of Artificial Sequence: Synthetic polypeptide
  C-term Amide
DCLGGVRKCIPDNDKCCRPNLVCSRTHKWCKYVF

SEQ ID NO: 752 - protein, 34 aa, Artificial Sequence
  Description of Artificial Sequence: Synthetic polypeptide
  C-term Amide
DCLGGIRKCIPDNDKCCRPNLVCSRTHKWCKYVF

SEQ ID NO: 753 - protein, 34 aa, Artificial Sequence
  Description of Artificial Sequence: Synthetic polypeptide
  MOD_RES (5)..(5): 2-Abu
  MOD_RES (6)..(6): Nle
  C-term Amide
DCLGXXRKCIPDNDKCCRPNLVCSRTHKWCKYVF

SEQ ID NO: 754 - protein, 34 aa, Artificial Sequence
  Description of Artificial Sequence: Synthetic polypeptide
  C-term Amide
DCLGGFRKCEPDNDKCCRPNLVCSRTHKWCKYVF

SEQ ID NO: 755 - protein, 34 aa, Artificial Sequence
  Description of Artificial Sequence: Synthetic polypeptide
  C-term Amide
DCLGGFRKCIPDNDKCCRPNLVCSRTHEWCKYVF

SEQ ID NO: 756 - protein, 34 aa, Artificial Sequence
  Description of Artificial Sequence: Synthetic polypeptide
  N-term 4-Pen
  MOD_RES (13)..(13): 2-Abu
  C-term Amide
DCLGAFRKCIPDXDKCCRPNLVCSRTHRWCKYVF

SEQ ID NO: 757 - protein, 34 aa, Artificial Sequence; identical to SEQ ID NO: 520
  Description of Artificial Sequence: Synthetic polypeptide
  N-term 4-Pen
  MOD_RES (13)..(13): 2-Abu
  C-term Amide

SEQ ID NO: 758 - protein, 34 aa, Artificial Sequence
  Description of Artificial Sequence: Synthetic polypeptide
  N-term 4-Pen
  MOD_RES (5)..(5): 2-Abu
  MOD_RES (13)..(13): 2-Abu
  C-term Amide
DCLGXLRKCIPDXDKCCRPNLVCSRTHKWCKYVF

SEQ ID NO: 759 - protein, 34 aa, Artificial Sequence
  Description of Artificial Sequence: Synthetic polypeptide
  N-term 4-Pen
  MOD_RES (5)..(5): Nva
  MOD_RES (13)..(13): 2-Abu
  C-term Amide
DCLGXLRKCIPDXDKCCRPNLVCSRTHRWCKYVF

SEQ ID NO: 760 - protein, 34 aa, Artificial Sequence; identical to SEQ ID NO: 758
  Description of Artificial Sequence: Synthetic polypeptide
  N-term 4-Pen
  MOD_RES (5)..(5): Nva
  MOD_RES (13)..(13): 2-Abu
  C-term Amide

SEQ ID NO: 761 - protein, 34 aa, Artificial Sequence; identical to SEQ ID NO: 740
  Description of Artificial Sequence: Synthetic polypeptide
  MOD_RES (28)..(28): Guf
  C-term Amide

SEQ ID NO: 762 - protein, 34 aa, Artificial Sequence; identical to SEQ ID NO: 740
  Description of Artificial Sequence: Synthetic polypeptide
  MOD_RES (28)..(28): Dab
  C-term Amide

SEQ ID NO: 763 - protein, 34 aa, Artificial Sequence
  Description of Artificial Sequence: Synthetic polypeptide
  C-term Amide
DCLGFMRKCIPDNDKCCRPNLVCSRTHQWCKYVF

SEQ ID NO: 764 - protein, 34 aa, Artificial Sequence
  Description of Artificial Sequence: Synthetic polypeptide
  C-term Amide
DCLGAMRKCIPDNDKCCRPNLVCSRTHFWCKYVF

SEQ ID NO: 765 - protein, 34 aa, Artificial Sequence
  Description of Artificial Sequence: Synthetic polypeptide
  C-term Amide
DCLGAMRKCIPDNDKCCRPNLVCSRTHYWCKYVF

SEQ ID NO: 766 - protein, 34 aa, Artificial Sequence
  Description of Artificial Sequence: Synthetic polypeptide
  C-term Amide
DCLGAMRKCIPDNDKCCRPNLVCSRTHLWCKYVF

SEQ ID NO: 767 - protein, 34 aa, Artificial Sequence
  Description of Artificial Sequence: Synthetic polypeptide
  C-term Amide
DCLGAMRKCIPDNDKCCRPNLVCSRTHNWCKYVF

SEQ ID NO: 768 - protein, 34 aa, Artificial Sequence
  Description of Artificial Sequence: Synthetic polypeptide
  MOD_RES (25)..(25): Cit
  C-term Amide
DCLGAMRKCIPDNDKCCRPNLVCSXTHKWCKYVF

SEQ ID NO: 769 - protein, 34 aa, Artificial Sequence
  Description of Artificial Sequence: Synthetic polypeptide
  C-term Amide
DCLGAMRKCIPDNDKCCRPNLVCSRTHDWCKYVF

SEQ ID NO: 770 - protein, 34 aa, Artificial Sequence
  Description of Artificial Sequence: Synthetic polypeptide
  C-term Amide
DCLGAMRKCIPDNDKCCRPNLVCSRTHMWCKYVF

SEQ ID NO: 771 - protein, 34 aa, Artificial Sequence; identical to SEQ ID NO: 740
  Description of Artificial Sequence: Synthetic polypeptide
  MOD_RES (28)..(28): Lys(Me)
  C-term Amide

SEQ ID NO: 772 - protein, 34 aa, Artificial Sequence; identical to SEQ ID NO: 239
  Description of Artificial Sequence: Synthetic polypeptide
  MOD_RES (28)..(28): pSer
  C-term Amide

SEQ ID NO: 773 - protein, 34 aa, Artificial Sequence
  Description of Artificial Sequence: Synthetic polypeptide
  C-term Amide
DCLGTMRKCDPENDKCCRPNLVCSRTHKWCKYVF

SEQ ID NO: 774 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKYEF

SEQ ID NO: 775 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKEVF

SEQ ID NO: 776 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCEYVF

SEQ ID NO: 777 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKYAF

SEQ ID NO: 778 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCKAVF

SEQ ID NO: 779 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHKWCAYVF

SEQ ID NO: 780 - protein, 34 aa, Artificial Sequence
  Description of Artificial Sequence: Synthetic polypeptide
  MOD_RES (10)..(10): 1-Nal
  C-term Amide
DCLGFMRKCXPDNDKCCRPNLVCSRTHEWCKYVF

SEQ ID NO: 781 - protein, 34 aa, Artificial Sequence
  Description of Artificial Sequence: Synthetic polypeptide
  MOD_RES (10)..(10): 1-Nal
  C-term Amide
DCLGFMRKCXPDNDECCRPNLVCSRTHKWCKYVF

SEQ ID NO: 782 - protein, 34 aa, Artificial Sequence
  Description of Artificial Sequence: Synthetic polypeptide
  MOD_RES (10)..(10): 1-Nal
  C-term Amide
DCLGFMRECXPDNDKCCRPNLVCSRTHKWCKYVF

SEQ ID NO: 783 - protein, 34 aa, Artificial Sequence
  Description of Artificial Sequence: Synthetic polypeptide
  MOD_RES (10)..(10): 1-Nal
  C-term Amide
DCLEFMRKCXPDNDKCCRPNLVCSRTHKWCKYVF

SEQ ID NO: 784 - protein, 34 aa, Artificial Sequence
  Description of Artificial Sequence: Synthetic polypeptide
  MOD_RES (1)..(1): 1-Nal
  C-term Amide
XCLGFMRECIPDNDKCCRPNLVCSRTHKWCKYVF

SEQ ID NO: 785 - protein, 34 aa, Artificial Sequence
  Description of Artificial Sequence: Synthetic polypeptide
  MOD_RES (1)..(1): 1-Nal
  C-term Amide
XCLGFMEKCIPDNDKCCRPNLVCSRTHKWCKYVF

SEQ ID NO: 786 - protein, 34 aa, Artificial Sequence
  Description of Artificial Sequence: Synthetic polypeptide
  MOD_RES (1)..(1): 1-Nal
  C-term Amide
XCLGFERKCIPDNDKCCRPNLVCSRTHKWCKYVF

SEQ ID NO: 787 - protein, 34 aa, Artificial Sequence
  Description of Artificial Sequence: Synthetic polypeptide
  C-term Amide
DCLGAMRKCIPDNDKCCRPNLVCSREHKWCKYVF

SEQ ID NO: 788 - protein, 34 aa, Artificial Sequence
  Description of Artificial Sequence: Synthetic polypeptide
  C-term Amide
DCLGAMRKCIPDNDKCCRPNLVCSRTEKWCKYVF

SEQ ID NO: 789 - protein, 34 aa, Artificial Sequence
  Description of Artificial Sequence: Synthetic polypeptide
  C-term Amide
DCLGAMRKCIPDNDKCCRPNLVCSRTHKWCEYVF

SEQ ID NO: 790 - protein, 35 aa, Artificial Sequence
  Description of Artificial Sequence: Synthetic polypeptide
  C-term Amide
DCLGAMRKCIPDNDKCCRPNLVCSRTHKWCKYVFE

SEQ ID NO: 791 - protein, 34 aa, Artificial Sequence; identical to SEQ ID NO: 256
  Description of Artificial Sequence: Synthetic polypeptide
  MOD_RES (6)..(6): Met[O]
  C-term Amide

SEQ ID NO: 792 - protein, 34 aa, Artificial Sequence; identical to SEQ ID NO: 256
  Description of Artificial Sequence: Synthetic polypeptide
  MOD_RES (6)..(6): Met[O]
  C-term Amide

SEQ ID NO: 793 - protein, 34 aa, Artificial Sequence; identical to SEQ ID NO: 520
  Description of Artificial Sequence: Synthetic polypeptide
  MOD_RES (13)..(13): Pra
  C-term Amide

SEQ ID NO: 794 - protein, 34 aa, Artificial Sequence; identical to SEQ ID NO: 520
  Description of Artificial Sequence: Synthetic polypeptide
  MOD_RES (13)..(13): K(Ac-Pra)
  C-term Amide

SEQ ID NO: 795 - protein, 34 aa, Artificial Sequence; identical to SEQ ID NO: 756
  Description of Artificial Sequence: Synthetic polypeptide
  MOD_RES (13)..(13): K(Ac-Pra)
  C-term Amide

SEQ ID NO: 796 - protein, 34 aa, Artificial Sequence
  Description of Artificial Sequence: Synthetic polypeptide
  MOD_RES (13)..(13): Pra
  C-term Amide
DCLGALRKCIPDXDKCCRPNLVCSRLHRWCKYVF

SEQ ID NO: 797 - protein, 34 aa, Artificial Sequence; identical to SEQ ID NO: 758
  Description of Artificial Sequence: Synthetic polypeptide
  MOD_RES (5)..(5): 2-Abu
  MOD_RES (13)..(13): Pra
  C-term Amide

SEQ ID NO: 798 - protein, 34 aa, Artificial Sequence
  Description of Artificial Sequence: Synthetic polypeptide
  MOD_RES (13)..(13): Pra
  C-term Amide
DCLGAFRKCEPDXDKCCRPNLVCSRLHRWCKYVF

SEQ ID NO: 799 - protein, 34 aa, Artificial Sequence; identical to SEQ ID NO: 758
  Description of Artificial Sequence: Synthetic polypeptide
  MOD_RES (5)..(5): 2-Abu
  MOD_RES (13)..(13): K(Ac-Pra)
  C-term Amide

SEQ ID NO: 800 - protein, 34 aa, Artificial Sequence
  Description of Artificial Sequence: Synthetic polypeptide
  MOD_RES (13)..(13): Pra
  C-term Amide
DCLGALRKCEPDXDKCCRPNLVCSRLHRWCKYVF

SEQ ID NO: 801 - protein, 34 aa, Artificial Sequence; identical to SEQ ID NO: 759
  Description of Artificial Sequence: Synthetic polypeptide
  MOD_RES (5)..(5): 2-Abu
  MOD_RES (13)..(13): K(4-Pen)
  C-term Amide

SEQ ID NO: 802 - protein, 34 aa, Artificial Sequence
  Description of Artificial Sequence: Synthetic polypeptide
  MOD_RES (12)..(12): Pra
  C-term Amide
DCLGALRKCIPXNDKCCRPNLVCSRLHRWCKYVF

SEQ ID NO: 803 - protein, 34 aa, Artificial Sequence
  Description of Artificial Sequence: Synthetic polypeptide
  MOD_RES (12)..(12): Pra
  C-term Amide
DCLGAFRKCIPXNDKCCRPNLVCSRLHRWCKYVF

SEQ ID NO: 804 - protein, 34 aa, Artificial Sequence
  Description of Artificial Sequence: Synthetic polypeptide
  MOD_RES (5)..(5): 2-Abu
  MOD_RES (13)..(13): K(4-Pen)
  C-term Amide
DCLGXFRKCIPDXDKCCRPNLVCSRTHKWCKYVF

SEQ ID NO: 805 - protein, 34 aa, Artificial Sequence; identical to SEQ ID NO: 759
  Description of Artificial Sequence: Synthetic polypeptide
  MOD_RES (5)..(5): Nva
  MOD_RES (13)..(13): K(4-Pen)
  C-term Amide

SEQ ID NO: 806 - protein, 34 aa, Artificial Sequence; identical to SEQ ID NO: 758
  Description of Artificial Sequence: Synthetic polypeptide
  MOD_RES (5)..(5): Nva
  MOD_RES (13)..(13): K(4-Pen)
  C-term Amide

SEQ ID NO: 807 - protein, 34 aa, Artificial Sequence; identical to SEQ ID NO: 759
  Description of Artificial Sequence: Synthetic polypeptide
  N-term 4-Pen
  MOD_RES (5)..(5): 2-Abu
  MOD_RES (13)..(13): 2-Abu
  C-term Amide

SEQ ID NO: 808 - protein, 34 aa, Artificial Sequence
  Description of Artificial Sequence: Synthetic polypeptide
  MOD_RES (5)..(5): 2-Abu
  MOD_RES (13)..(13): K(4-Pen)
  C-term Amide
DCLGXLRKCIPDXDKCCRPNLVCSRTHEWCKYVF

SEQ ID NO: 809 - protein, 34 aa, Artificial Sequence
  Description of Artificial Sequence: Synthetic polypeptide
  C-term Amide
DCLGAFRKCIPDNDKCCRPNLVCSRTHRWCKYVF

SEQ ID NO: 810 - protein, 34 aa, Artificial Sequence
  Description of Artificial Sequence: Synthetic polypeptide
  C-term Amide
DCLGALRKCIPDNDKCCRPNLVCSRTHRWCKYVF

SEQ ID NO: 811 - protein, 36 aa, Artificial Sequence
  Description of Artificial Sequence: Synthetic polypeptide
  C-term Amide
GSDCLGAFRKCIPDNDKCCRPNLVCSRTHRWCKYVF

SEQ ID NO: 812 - protein, 36 aa, Artificial Sequence
  Description of Artificial Sequence: Synthetic polypeptide
  C-term Amide
GSDCLGALRKCIPDNDKCCRPNLVCSRTHRWCKYVF

SEQ ID NO: 813 - protein, 35 aa, Artificial Sequence
  Description of Artificial Sequence: Synthetic polypeptide
  C-term Free Acid
DCLGAFRKCIPDNDKCCRPNLVCSRTHRWCKYVFW

SEQ ID NO: 814 - protein, 35 aa, Artificial Sequence
  Description of Artificial Sequence: Synthetic polypeptide
  C-term Free Acid
DCLGALRKCIPDNDKCCRPNLVCSRTHRWCKYVFW

SEQ ID NO: 815 - protein, 37 aa, Artificial Sequence
  Description of Artificial Sequence: Synthetic polypeptide
  C-term Free Acid
GSDCLGAFRKCIPDNDKCCRPNLVCSRTHRWCKYVFW

SEQ ID NO: 816 - protein, 37 aa, Artificial Sequence
  Description of Artificial Sequence: Synthetic polypeptide
  C-term Free Acid
GSDCLGALRKCIPDNDKCCRPNLVCSRTHRWCKYVFW

SEQ ID NO: 817 - protein, 35 aa, Artificial Sequence
  Description of Artificial Sequence: Synthetic polypeptide
  C-term Free Acid
DCLGAFRKCIPDNDKCCRPNLVCSRTHRWCKYVFF

SEQ ID NO: 818 - protein, 35 aa, Artificial Sequence
  Description of Artificial Sequence: Synthetic polypeptide
  C-term Free Acid
DCLGALRKCIPDNDKCCRPNLVCSRTHRWCKYVFF

SEQ ID NO: 819 - protein, 37 aa, Artificial Sequence
  Description of Artificial Sequence: Synthetic polypeptide
  C-term Free Acid
GSDCLGAFRKCIPDNDKCCRPNLVCSRTHRWCKYVFF

SEQ ID NO: 820 - protein, 37 aa, Artificial Sequence
  Description of Artificial Sequence: Synthetic polypeptide
  C-term Free Acid
GSDCLGALRKCIPDNDKCCRPNLVCSRTHRWCKYVFF

SEQ ID NO: 821 - protein, 36 aa, Artificial Sequence; identical to SEQ ID NO: 811
  Description of Artificial Sequence: Synthetic polypeptide
  C-term Free Acid

SEQ ID NO: 822 - protein, 36 aa, Artificial Sequence; identical to SEQ ID NO: 812
  Description of Artificial Sequence: Synthetic polypeptide
  C-term Free Acid

SEQ ID NO: 823 - protein, 34 aa, Artificial Sequence; identical to SEQ ID NO: 809
  Description of Artificial Sequence: Synthetic polypeptide
  C-term Free Acid

SEQ ID NO: 824 - protein, 34 aa, Artificial Sequence
  Description of Artificial Sequence: Synthetic polypeptide
  C-term Free Acid
DCLGAFRKCIPDNDKCCRPNLVCSRTHAWCKYVF

SEQ ID NO: 825 - protein, 34 aa, Artificial Sequence
  Description of Artificial Sequence: Synthetic polypeptide
  C-term Free Acid
DCLGAFRKCIPDNDKCCRPNLVCSRTHDWCKYVF

SEQ ID NO: 826 - protein, 34 aa, Artificial Sequence; identical to SEQ ID NO: 729
  Description of Artificial Sequence: Synthetic polypeptide
  C-term Free Acid

SEQ ID NO: 827 - protein, 34 aa, Artificial Sequence
  Description of Artificial Sequence: Synthetic polypeptide
  C-term Free Acid
DCLGAFRKCIPDNDKCCRPNLVCSRTHGWCKYVF

SEQ ID NO: 828 - protein, 34 aa, Artificial Sequence
  Description of Artificial Sequence: Synthetic polypeptide
  C-term Free Acid
DCLGAFRKCIPDNDKCCRPNLVCSRTHHWCKYVF

SEQ ID NO: 829 - protein, 34 aa, Artificial Sequence; identical to SEQ ID NO: 257
  Description of Artificial Sequence: Synthetic polypeptide
  C-term Free Acid

SEQ ID NO: 830 - protein, 34 aa, Artificial Sequence
  Description of Artificial Sequence: Synthetic polypeptide
  C-term Free Acid
DCLGAFRKCIPDNDKCCRPNLVCSRTHLWCKYVF

SEQ ID NO: 831 - protein, 34 aa, Artificial Sequence
  Description of Artificial Sequence: Synthetic polypeptide
  C-term Free Acid
DCLGAFRKCIPDNDKCCRPNLVCSRTHMWCKYVF

SEQ ID NO: 832 - protein, 34 aa, Artificial Sequence
  Description of Artificial Sequence: Synthetic polypeptide
  C-term Free Acid
DCLGAFRKCIPDNDKCCRPNLVCSRTHNWCKYVF

SEQ ID NO: 833 - protein, 34 aa, Artificial Sequence
  Description of Artificial Sequence: Synthetic polypeptide
  C-term Free Acid
DCLGAFRKCIPDNDKCCRPNLVCSRTHPWCKYVF

SEQ ID NO: 834 - protein, 34 aa, Artificial Sequence
  Description of Artificial Sequence: Synthetic polypeptide
  C-term Free Acid
DCLGAFRKCIPDNDKCCRPNLVCSRTHQWCKYVF

SEQ ID NO: 835 - protein, 34 aa, Artificial Sequence
  Description of Artificial Sequence: Synthetic polypeptide
  C-term Free Acid
DCLGAFRKCIPDNDKCCRPNLVCSRTHSWCKYVF

SEQ ID NO: 836 - protein, 34 aa, Artificial Sequence
  Description of Artificial Sequence: Synthetic polypeptide
  C-term Free Acid
DCLGAFRKCIPDADKCCRPNLVCSRTHRWCKYVF

SEQ ID NO: 837 - protein, 34 aa, Artificial Sequence
  Description of Artificial Sequence: Synthetic polypeptide
  C-term Free Acid
DCLGAFRKCIPDDDKCCRPNLVCSRTHRWCKYVF

SEQ ID NO: 838 - protein, 34 aa, Artificial Sequence
  Description of Artificial Sequence: Synthetic polypeptide
  C-term Free Acid
DCLGAFRKCIPDEDKCCRPNLVCSRTHRWCKYVF

SEQ ID NO: 839 - protein, 34 aa, Artificial Sequence
  Description of Artificial Sequence: Synthetic polypeptide
  C-term Free Acid
DCLGAFRKCIPDFDKCCRPNLVCSRTHRWCKYVF

SEQ ID NO: 840 - protein, 34 aa, Artificial Sequence
  Description of Artificial Sequence: Synthetic polypeptide
  C-term Free Acid
DCLGAFRKCIPDGDKCCRPNLVCSRTHRWCKYVF

SEQ ID NO: 841 - protein, 34 aa, Artificial Sequence
  Description of Artificial Sequence: Synthetic polypeptide
  C-term Free Acid
DCLGAFRKCIPDHDKCCRPNLVCSRTHRWCKYVF

SEQ ID NO: 842 - protein, 34 aa, Artificial Sequence
  Description of Artificial Sequence: Synthetic polypeptide
  C-term Free Acid
DCLGAFRKCIPDIDKCCRPNLVCSRTHRWCKYVF

SEQ ID NO: 843 - protein, 34 aa, Artificial Sequence
  Description of Artificial Sequence: Synthetic polypeptide
  C-term Free Acid
DCLGAFRKCIPDKDKCCRPNLVCSRTHRWCKYVF

SEQ ID NO: 844 - protein, 34 aa, Artificial Sequence
  Description of Artificial Sequence: Synthetic polypeptide
  C-term Free Acid
DCLGAFRKCIPDLDKCCRPNLVCSRTHRWCKYVF

SEQ ID NO: 845 - protein, 34 aa, Artificial Sequence
  Description of Artificial Sequence: Synthetic polypeptide
  C-term Free Acid
DCLGAFRKCIPDMDKCCRPNLVCSRTHRWCKYVF

SEQ ID NO: 846 - protein, 34 aa, Artificial Sequence
  Description of Artificial Sequence: Synthetic polypeptide
  C-term Free Acid
DCLGAFRKCIPDPDKCCRPNLVCSRTHRWCKYVF

SEQ ID NO: 847 - protein, 34 aa, Artificial Sequence
  Description of Artificial Sequence: Synthetic polypeptide
  C-term Free Acid
DCLGAFRKCIPDQDKCCRPNLVCSRTHRWCKYVF

SEQ ID NO: 848 - protein, 34 aa, Artificial Sequence
  Description of Artificial Sequence: Synthetic polypeptide
  C-term Free Acid
DCLGAFRKCIPDRDKCCRPNLVCSRTHRWCKYVF

SEQ ID NO: 849 - protein, 34 aa, Artificial Sequence
  Description of Artificial Sequence: Synthetic polypeptide
  C-term Free Acid
DCLGAFRKCIPDSDKCCRPNLVCSRTHRWCKYVF

SEQ ID NO: 850 - protein, 34 aa, Artificial Sequence
  Description of Artificial Sequence: Synthetic polypeptide
  C-term Free Acid
DCLGAFRKCIPDTDKCCRPNLVCSRTHRWCKYVF

SEQ ID NO: 851 - protein, 34 aa, Artificial Sequence
  Description of Artificial Sequence: Synthetic polypeptide
  C-term Free Acid
DCLGAFRKCIPDVDKCCRPNLVCSRTHRWCKYVF

SEQ ID NO: 852 - protein, 34 aa, Artificial Sequence
  Description of Artificial Sequence: Synthetic polypeptide
  C-term Free Acid
DCLGAFRKCIPDWDKCCRPNLVCSRTHRWCKYVF

SEQ ID NO: 853 - protein, 34 aa, Artificial Sequence; identical to SEQ ID NO: 810
  Description of Artificial Sequence: Synthetic polypeptide
  C-term Free Acid

SEQ ID NO: 854 - protein, 34 aa, Artificial Sequence
  Description of Artificial Sequence: Synthetic polypeptide
  C-term Free Acid
DCLGALRKCIPDNDKCCRPNLVCSRTHDWCKYVF

SEQ ID NO: 855 - protein, 34 aa, Artificial Sequence; identical to SEQ ID NO: 728
  Description of Artificial Sequence: Synthetic polypeptide
  C-term Free Acid

SEQ ID NO: 856 - protein, 34 aa, Artificial Sequence
  Description of Artificial Sequence: Synthetic polypeptide
  C-term Free Acid
DCLGALRKCIPDNDKCCRPNLVCSRTHLWCKYVF

SEQ ID NO: 857 - protein, 34 aa, Artificial Sequence
  Description of Artificial Sequence: Synthetic polypeptide
  C-term Free Acid
DCLGALRKCIPDNDKCCRPNLVCSRTHMWCKYVF

SEQ ID NO: 858 - protein, 34 aa, Artificial Sequence
  Description of Artificial Sequence: Synthetic polypeptide
  C-term Free Acid
DCLGALRKCIPDNDKCCRPNLVCSRTHQWCKYVF

SEQ ID NO: 859 - protein, 34 aa, Artificial Sequence
  Description of Artificial Sequence: Synthetic polypeptide
  C-term Free Acid
DCLGALRKCIPDNDKCCRPNLVCSRTHSWCKYVF

SEQ ID NO: 860 - protein, 34 aa, Artificial Sequence
  Description of Artificial Sequence: Synthetic polypeptide
  C-term Free Acid
DCLGALRKCIPDADKCCRPNLVCSRTHRWCKYVF

SEQ ID NO: 861 - protein, 34 aa, Artificial Sequence
  Description of Artificial Sequence: Synthetic polypeptide
  C-term Free Acid
DCLGALRKCIPDDDKCCRPNLVCSRTHRWCKYVF

SEQ ID NO: 862 - protein, 34 aa, Artificial Sequence
  Description of Artificial Sequence: Synthetic polypeptide
  C-term Free Acid
DCLGALRKCIPDEDKCCRPNLVCSRTHRWCKYVF

SEQ ID NO: 863 - protein, 34 aa, Artificial Sequence
  Description of Artificial Sequence: Synthetic polypeptide
  C-term Free Acid
DCLGALRKCIPDFDKCCRPNLVCSRTHRWCKYVF

SEQ ID NO: 864 - protein, 34 aa, Artificial Sequence
  Description of Artificial Sequence: Synthetic polypeptide
  C-term Free Acid
DCLGALRKCIPDHDKCCRPNLVCSRTHRWCKYVF

SEQ ID NO: 865 - protein, 34 aa, Artificial Sequence
  Description of Artificial Sequence: Synthetic polypeptide
  C-term Free Acid
DCLGALRKCIPDIDKCCRPNLVCSRTHRWCKYVF

SEQ ID NO: 866 - protein, 34 aa, Artificial Sequence
  Description of Artificial Sequence: Synthetic polypeptide
  C-term Free Acid
DCLGALRKCIPDKDKCCRPNLVCSRTHRWCKYVF

SEQ ID NO: 867 - protein, 34 aa, Artificial Sequence
  Description of Artificial Sequence: Synthetic polypeptide
  C-term Free Acid
DCLGALRKCIPDLDKCCRPNLVCSRTHRWCKYVF

SEQ ID NO: 868 - protein, 34 aa, Artificial Sequence
  Description of Artificial Sequence: Synthetic polypeptide
  C-term Free Acid
DCLGALRKCIPDMDKCCRPNLVCSRTHRWCKYVF

SEQ ID NO: 869 - protein, 34 aa, Artificial Sequence
  Description of Artificial Sequence: Synthetic polypeptide
  C-term Free Acid
DCLGALRKCIPDQDKCCRPNLVCSRTHRWCKYVF

SEQ ID NO: 870 - protein, 34 aa, Artificial Sequence
  Description of Artificial Sequence: Synthetic polypeptide
  C-term Free Acid
DCLGALRKCIPDRDKCCRPNLVCSRTHRWCKYVF

SEQ ID NO: 871 - protein, 34 aa, Artificial Sequence
  Description of Artificial Sequence: Synthetic polypeptide
  C-term Free Acid
DCLGALRKCIPDSDKCCRPNLVCSRTHRWCKYVF

SEQ ID NO: 872 - protein, 34 aa, Artificial Sequence
  Description of Artificial Sequence: Synthetic polypeptide
  C-term Free Acid
DCLGALRKCIPDVDKCCRPNLVCSRTHRWCKYVF

SEQ ID NO: 873 - protein, 34 aa, Artificial Sequence
  Description of Artificial Sequence: Synthetic polypeptide
  C-term Free Acid
DCLGALRKCIPDYDKCCRPNLVCSRTHRWCKYVF

SEQ ID NO: 874 - protein, 37 aa, Artificial Sequence
  Description of Artificial Sequence: Synthetic polypeptide
  C-term Free Acid
GSDCLGALRKCIPDNDKCCRPNLVCSRTHRWCKYVFG

SEQ ID NO: 875 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFG

SEQ ID NO: 876 - protein, 38 aa, Artificial Sequence
  Description of Artificial Sequence: Synthetic polypeptide
  C-term Free Acid
GSDCLGALRKCIPDADKCCRPNLVCSRTHRWCKYVFFG

SEQ ID NO: 877 - protein, 37 aa, Artificial Sequence
  Description of Artificial Sequence: Synthetic polypeptide
  C-term Free Acid
GSDCLGALRKCIPDNDKCCRPNLVCSRTHRWCKYVFI

SEQ ID NO: 878 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFI

SEQ ID NO: 879 - protein, 37 aa, Artificial Sequence
  Description of Artificial Sequence: Synthetic polypeptide
  C-term Free Acid
GSDCLGALRKCIPDADKCCRPNLVCSRTHRWCKYVFI

SEQ ID NO: 880 - protein, 38 aa, Artificial Sequence
  Description of Artificial Sequence: Synthetic polypeptide
  C-term Free Acid
GSDCLGALRKCIPDADKCCRPNLVCSRTHRWCKYVFFI

SEQ ID NO: 881 - protein, 37 aa, Artificial Sequence
  Description of Artificial Sequence: Synthetic polypeptide
  C-term Free Acid
GSDCLGALRKCIPDNDKCCRPNLVCSRTHRWCKYVFL

SEQ ID NO: 882 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFL

SEQ ID NO: 883 - protein, 37 aa, Artificial Sequence
  Description of Artificial Sequence: Synthetic polypeptide
  C-term Free Acid
GSDCLGALRKCIPDADKCCRPNLVCSRTHRWCKYVFL

SEQ ID NO: 884 - protein, 38 aa, Artificial Sequence
  Description of Artificial Sequence: Synthetic polypeptide
  C-term Free Acid
GSDCLGALRKCIPDADKCCRPNLVCSRTHRWCKYVFFL

SEQ ID NO: 885 - protein, 37 aa, Artificial Sequence
  Description of Artificial Sequence: Synthetic polypeptide
  C-term Free Acid
GSDCLGALRKCIPDNDKCCRPNLVCSRTHRWCKYVFS

SEQ ID NO: 886 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFS

SEQ ID NO: 887 - protein, 37 aa, Artificial Sequence
  Description of Artificial Sequence: Synthetic polypeptide
  C-term Free Acid
GSDCLGALRKCIPDADKCCRPNLVCSRTHRWCKYVFS

SEQ ID NO: 888 - protein, 38 aa, Artificial Sequence
  Description of Artificial Sequence: Synthetic polypeptide
  C-term Free Acid
GSDCLGALRKCIPDADKCCRPNLVCSRTHRWCKYVFFS

SEQ ID NO: 889 - protein, 37 aa, Artificial Sequence
  Description of Artificial Sequence: Synthetic polypeptide
  C-term Free Acid
GSDCLGALRKCIPDNDKCCRPNLVCSRTHRWCKYVFT

SEQ ID NO: 890 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFT

SEQ ID NO: 891 - protein, 37 aa, Artificial Sequence
  Description of Artificial Sequence: Synthetic polypeptide
  C-term Free Acid
GSDCLGALRKCIPDADKCCRPNLVCSRTHRWCKYVFT

SEQ ID NO: 892 - protein, 38 aa, Artificial Sequence
  Description of Artificial Sequence: Synthetic polypeptide
  C-term Free Acid
GSDCLGALRKCIPDADKCCRPNLVCSRTHRWCKYVFFT

SEQ ID NO: 893 - protein, 37 aa, Artificial Sequence
  Description of Artificial Sequence: Synthetic polypeptide
  C-term Free Acid
GSDCLGALRKCIPDNDKCCRPNLVCSRTHRWCKYVFY

SEQ ID NO: 894 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFY

SEQ ID NO: 895 - protein, 37 aa, Artificial Sequence
  Description of Artificial Sequence: Synthetic polypeptide
  C-term Free Acid
GSDCLGALRKCIPDADKCCRPNLVCSRTHRWCKYVFY

SEQ ID NO: 896 - protein, 38 aa, Artificial Sequence
  Description of Artificial Sequence: Synthetic polypeptide
  C-term Free Acid
GSDCLGALRKCIPDADKCCRPNLVCSRTHRWCKYVFFY

SEQ ID NO: 897 - protein, 37 aa, Artificial Sequence
  Description of Artificial Sequence: Synthetic polypeptide
  C-term Free Acid
GSDCLGALRKCIPDNDKCCRPNLVCSRTHRWCKYVFA

SEQ ID NO: 898 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFA

SEQ ID NO: 899 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFFA

SEQ ID NO: 900 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFYA

SEQ ID NO: 901 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFLA

SEQ ID NO: 902 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFIA

SEQ ID NO: 903 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFAA

SEQ ID NO: 904 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFSA

SEQ ID NO: 905 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFTA

SEQ ID NO: 906 - protein, 39 aa, Artificial Sequence; identical to SEQ ID NO: 903
  Description of Artificial Sequence: Synthetic polypeptide
  C-term Free Acid

SEQ ID NO: 907 - protein, 39 aa, Artificial Sequence
  Description of Artificial Sequence: Synthetic polypeptide
  C-term Free Acid
GSDCLGALRKCIPDNDKCCRPNLVCSRTHRWCKYVFFGA

SEQ ID NO: 908 - protein, 37 aa, Artificial Sequence
  Description of Artificial Sequence: Synthetic polypeptide
  C-term Free Acid
GSDCLGALRKCIPDADKCCRPNLVCSRTHRWCKYVFA

SEQ ID NO: 909 - protein, 38 aa, Artificial Sequence
  Description of Artificial Sequence: Synthetic polypeptide
  C-term Free Acid
GSDCLGALRKCIPDADKCCRPNLVCSRTHRWCKYVFFA

SEQ ID NO: 910 - protein, 39 aa, Artificial Sequence
  Description of Artificial Sequence: Synthetic polypeptide
  C-term Free Acid
GSDCLGALRKCIPDADKCCRPNLVCSRTHRWCKYVFFFA

SEQ ID NO: 911 - protein, 39 aa, Artificial Sequence
  Description of Artificial Sequence: Synthetic polypeptide
  C-term Free Acid
GSDCLGALRKCIPDADKCCRPNLVCSRTHRWCKYVFFYA

SEQ ID NO: 912 - protein, 39 aa, Artificial Sequence
  Description of Artificial Sequence: Synthetic polypeptide
  C-term Free Acid
GSDCLGALRKCIPDADKCCRPNLVCSRTHRWCKYVFFLA

SEQ ID NO: 913 - protein, 39 aa, Artificial Sequence
  Description of Artificial Sequence: Synthetic polypeptide
  C-term Free Acid
GSDCLGALRKCIPDADKCCRPNLVCSRTHRWCKYVFFIA

SEQ ID NO: 914 - protein, 39 aa, Artificial Sequence
  Description of Artificial Sequence: Synthetic polypeptide
  C-term Free Acid
GSDCLGALRKCIPDADKCCRPNLVCSRTHRWCKYVFFAA

SEQ ID NO: 915 - protein, 39 aa, Artificial Sequence
  Description of Artificial Sequence: Synthetic polypeptide
  C-term Free Acid
GSDCLGALRKCIPDADKCCRPNLVCSRTHRWCKYVFFSA

SEQ ID NO: 916 - protein, 39 aa, Artificial Sequence
  Description of Artificial Sequence: Synthetic polypeptide
  C-term Free Acid
GSDCLGALRKCIPDADKCCRPNLVCSRTHRWCKYVFFTA

SEQ ID NO: 917 - protein, 39 aa, Artificial Sequence; identical to SEQ ID NO: 914
  Description of Artificial Sequence: Synthetic polypeptide
  C-term Free Acid

SEQ ID NO: 918 - protein, 39 aa, Artificial Sequence
  Description of Artificial Sequence: Synthetic polypeptide
  C-term Free Acid
GSDCLGALRKCIPDADKCCRPNLVCSRTHRWCKYVFFGA

SEQ ID NO: 919 - protein, 37 aa, Artificial Sequence; identical to SEQ ID NO: 897
  Description of Artificial Sequence: Synthetic polypeptide
  C-term Free Acid

SEQ ID NO: 920 - protein, 38 aa, Artificial Sequence; identical to SEQ ID NO: 898
  Description of Artificial Sequence: Synthetic polypeptide
  C-term Free Acid

SEQ ID NO: 921 - protein, 37 aa, Artificial Sequence; identical to SEQ ID NO: 908
  Description of Artificial Sequence: Synthetic polypeptide
  C-term Free Acid

SEQ ID NO: 922 - protein, 38 aa, Artificial Sequence; identical to SEQ ID NO: 909
  Description of Artificial Sequence: Synthetic polypeptide
  C-term Free Acid

SEQ ID NO: 923 - protein, 38 aa, Artificial Sequence
  Description of Artificial Sequence: Synthetic polypeptide
  C-term Free Acid
GSDCLGALRKCIPDNDKCCRPNLVCSRTHRWCKYVFFF

SEQ ID NO: 924 - protein, 38 aa, Artificial Sequence
  Description of Artificial Sequence: Synthetic polypeptide
  C-term Free Acid
GGSDCLGALRKCIPDNDKCCRPNLVCSRTHRWCKYVFF

SEQ ID NO: 925 - protein, 39 aa, Artificial Sequence
  Description of Artificial Sequence: Synthetic polypeptide
  C-term Free Acid
GGGSDCLGALRKCIPDNDKCCRPNLVCSRTHRWCKYVFF

SEQ ID NO: 926 - protein, 40 aa, Artificial Sequence
  Description of Artificial Sequence: Synthetic polypeptide
  C-term Free Acid
GGGGSDCLGALRKCIPDNDKCCRPNLVCSRTHRWCKYVFF

SEQ ID NO: 927 - protein, 41 aa, Artificial Sequence
  Description of Artificial Sequence: Synthetic polypeptide
  C-term Free Acid
SGGGGSDCLGALRKCIPDNDKCCRPNLVCSRTHRWCKYVFF

SEQ ID NO: 928 - protein, 42 aa, Artificial Sequence
  Description of Artificial Sequence: Synthetic polypeptide
  C-term Free Acid
GSGGGGSDCLGALRKCIPDNDKCCRPNLVCSRTHRWCKYVFF

SEQ ID NO: 929 - protein, 43 aa, Artificial Sequence
  Description of Artificial Sequence: Synthetic polypeptide
  C-term Free Acid
GGSGGGGSDCLGALRKCIPDNDKCCRPNLVCSRTHRWCKYVFF

SEQ ID NO: 930 - protein, 44 aa, Artificial Sequence
  Description of Artificial Sequence: Synthetic polypeptide
  C-term Free Acid
GGGSGGGGSDCLGALRKCIPDNDKCCRPNLVCSRTHRWCKYVFF

SEQ ID NO: 931 - protein, 45 aa, Artificial Sequence
  Description of Artificial Sequence: Synthetic polypeptide
  C-term Free Acid
GGGGSGGGGSDCLGALRKCIPDNDKCCRPNLVCSRTHRWCKYVFF

SEQ ID NO: 932 - protein, 45 aa, Artificial Sequence
  Description of Artificial Sequence: Synthetic polypeptide
  C-term Free Acid
GGGGSGGGGSDCLGAFRKCIPDNDKCCRPNLVCSRTHRWCKYVFF

SEQ ID NO: 933 - protein, 45 aa, Artificial Sequence
  Description of Artificial Sequence: Synthetic polypeptide
  C-term Free Acid
GGGGSGGGGSDCLGAFRKCIPDADKCCRPNLVCSRTHRWCKYVFF

SEQ ID NO: 934 - protein, 37 aa, Artificial Sequence
  Description of Artificial Sequence: Synthetic polypeptide
  C-term Free Acid
GSDCLGALRKCIPDADKCCRPNLVCSRTHRWCKYVFF

SEQ ID NO: 935 - protein, 38 aa, Artificial Sequence
  Description of Artificial Sequence: Synthetic polypeptide
  C-term Free Acid
GSDCLGALRKCIPDADKCCRPNLVCSRTHRWCKYVFGF

SEQ ID NO: 936 - protein, 37 aa, Artificial Sequence; identical to SEQ ID NO: 934
  Description of Artificial Sequence: Synthetic polypeptide
  C-term Free Acid

SEQ ID NO: 937 - protein, 37 aa, Artificial Sequence; identical to SEQ ID NO: 934
  Description of Artificial Sequence: Synthetic polypeptide
  C-term Free Acid

SEQ ID NO: 938 - protein, 38 aa, Artificial Sequence
  Description of Artificial Sequence: Synthetic polypeptide
  C-term Free Acid
GGSDCLGALRKCIPDADKCCRPNLVCSRTHRWCKYVFF

SEQ ID NO: 939 - protein, 39 aa, Artificial Sequence
  Description of Artificial Sequence: Synthetic polypeptide
  C-term Free Acid
GGGSDCLGALRKCIPDADKCCRPNLVCSRTHRWCKYVFF

SEQ ID NO: 940 - protein, 40 aa, Artificial Sequence
  Description of Artificial Sequence: Synthetic polypeptide
  C-term Free Acid
GGGGSDCLGALRKCIPDADKCCRPNLVCSRTHRWCKYVFF

SEQ ID NO: 941 - protein, 41 aa, Artificial Sequence
  Description of Artificial Sequence: Synthetic polypeptide
  C-term Free Acid
SGGGGSDCLGALRKCIPDADKCCRPNLVCSRTHRWCKYVFF

SEQ ID NO: 942 - protein, 42 aa, Artificial Sequence
  Description of Artificial Sequence: Synthetic polypeptide
  C-term Free Acid
GSGGGGSDCLGALRKCIPDADKCCRPNLVCSRTHRWCKYVFF

SEQ ID NO: 943 - protein, 43 aa, Artificial Sequence
  Description of Artificial Sequence: Synthetic polypeptide
  C-term Free Acid
GGSGGGGSDCLGALRKCIPDADKCCRPNLVCSRTHRWCKYVFF

SEQ ID NO: 944 - protein, 44 aa, Artificial Sequence
  Description of Artificial Sequence: Synthetic polypeptide
  C-term Free Acid
GGGSGGGGSDCLGALRKCIPDADKCCRPNLVCSRTHRWCKYVFF

SEQ ID NO: 945 - protein, 45 aa, Artificial Sequence
  Description of Artificial Sequence: Synthetic polypeptide
  C-term Free Acid
GGGGSGGGGSDCLGALRKCIPDADKCCRPNLVCSRTHRWCKYVFF

SEQ ID NO: 946 - protein, 37 aa, Artificial Sequence
  Description of Artificial Sequence: Synthetic polypeptide
  C-term Free Acid
GSDCLGALRKCIPDGDKCCRPNLVCSRTHRWCKYVFF

SEQ ID NO: 947 - protein, 37 aa, Artificial Sequence
  Description of Artificial Sequence: Synthetic polypeptide
  C-term Free Acid
GSDCLGALRKCIPDSDKCCRPNLVCSRTHRWCKYVFF

SEQ ID NO: 948 - protein, 37 aa, Artificial Sequence
  Description of Artificial Sequence: Synthetic polypeptide
  C-term Free Acid
GSDCLGALRKCIPDIDKCCRPNLVCSRTHRWCKYVFF

SEQ ID NO: 949 - protein, 37 aa, Artificial Sequence
  Description of Artificial Sequence: Synthetic polypeptide
  C-term Free Acid
GSDCLGALRKCIPDPDKCCRPNLVCSRTHRWCKYVFF

SEQ ID NO: 950 - protein, 37 aa, Artificial Sequence
  Description of Artificial Sequence: Synthetic polypeptide
  C-term Free Acid
GSDCLGALRKCIPDMDKCCRPNLVCSRTHRWCKYVFF

SEQ ID NO: 951 - protein, 37 aa, Artificial Sequence
  Description of Artificial Sequence: Synthetic polypeptide
  C-term Free Acid
GSDCLGALRKCIPDVDKCCRPNLVCSRTHRWCKYVFF

SEQ ID NO: 952 - protein, 37 aa, Artificial Sequence
  Description of Artificial Sequence: Synthetic polypeptide
  C-term Free Acid
GSDCLGALRKCIPDTDKCCRPNLVCSRTHRWCKYVFF

SEQ ID NO: 953 - protein, 37 aa, Artificial Sequence
  Description of Artificial Sequence: Synthetic polypeptide
  C-term Free Acid
GSDCLGALRKCIPDFDKCCRPNLVCSRTHRWCKYVFF

SEQ ID NO: 954 - protein, 37 aa, Artificial Sequence
  Description of Artificial Sequence: Synthetic polypeptide
  C-term Free Acid
GSDCLGALRKCIPDYDKCCRPNLVCSRTHRWCKYVFF

SEQ ID NO: 955 - protein, 37 aa, Artificial Sequence
  Description of Artificial Sequence: Synthetic polypeptide
  C-term Free Acid
GSDCLGAFRKCIPDGDKCCRPNLVCSRTHRWCKYVFF

SEQ ID NO: 956 - protein, 37 aa, Artificial Sequence
  Description of Artificial Sequence: Synthetic polypeptide
  C-term Free Acid
GSDCLGAFRKCIPDSDKCCRPNLVCSRTHRWCKYVFF

SEQ ID NO: 957 - protein, 37 aa, Artificial Sequence
  Description of Artificial Sequence: Synthetic polypeptide
  C-term Free Acid
GSDCLGAFRKCIPDIDKCCRPNLVCSRTHRWCKYVFF

SEQ ID NO: 958 - protein, 37 aa, Artificial Sequence
  Description of Artificial Sequence: Synthetic polypeptide
  C-term Free Acid
GSDCLGAFRKCIPDLDKCCRPNLVCSRTHRWCKYVFF

SEQ ID NO: 959 - protein, 37 aa, Artificial Sequence
  Description of Artificial Sequence: Synthetic polypeptide
  C-term Free Acid
GSDCLGAFRKCIPDMDKCCRPNLVCSRTHRWCKYVFF

SEQ ID NO: 960 - protein, 37 aa, Artificial Sequence
  Description of Artificial Sequence: Synthetic polypeptide
  C-term Free Acid
GSDCLGAFRKCIPDVDKCCRPNLVCSRTHRWCKYVFF

SEQ ID NO: 961 - protein, 37 aa, Artificial Sequence
  Description of Artificial Sequence: Synthetic polypeptide
  C-term Free Acid
GSDCLGAFRKCIPDTDKCCRPNLVCSRTHRWCKYVFF

SEQ ID NO: 962 - protein, 37 aa, Artificial Sequence
  Description of Artificial Sequence: Synthetic polypeptide
  C-term Free Acid
GSDCLGAFRKCIPDFDKCCRPNLVCSRTHRWCKYVFF

SEQ ID NO: 963 - protein, 37 aa, Artificial Sequence
  Description of Artificial Sequence: Synthetic polypeptide
  C-term Free Acid
GSDCLGAFRKCIPDYDKCCRPNLVCSRTHRWCKYVFF

SEQ ID NO: 964 - protein, 37 aa, Artificial Sequence
  Description of Artificial Sequence: Synthetic polypeptide
  C-term Free Acid
GIDCLGALRKCIPDNDKCCRPNLVCSRTHRWCKYVFF

SEQ ID NO: 965 - protein, 37 aa, Artificial Sequence
  Description of Artificial Sequence: Synthetic polypeptide
  C-term Free Acid
GADCLGALRKCIPDNDKCCRPNLVCSRTHRWCKYVFF

SEQ ID NO: 966 - protein, 37 aa, Artificial Sequence
  Description of Artificial Sequence: Synthetic polypeptide
  C-term Free Acid
GTDCLGALRKCIPDNDKCCRPNLVCSRTHRWCKYVFF

SEQ ID NO: 967 - protein, 37 aa, Artificial Sequence; identical to SEQ ID NO: 965
  Description of Artificial Sequence: Synthetic polypeptide
  C-term Free Acid

SEQ ID NO: 968 - protein, 37 aa, Artificial Sequence
  Description of Artificial Sequence: Synthetic polypeptide
  C-term Free Acid
GGDCLGALRKCIPDNDKCCRPNLVCSRTHRWCKYVFF

SEQ ID NO: 969 - protein, 37 aa, Artificial Sequence
  Description of Artificial Sequence: Synthetic polypeptide
  C-term Free Acid
GFDCLGALRKCIPDNDKCCRPNLVCSRTHRWCKYVFF

SEQ ID NO: 970 - protein, 37 aa, Artificial Sequence
  Description of Artificial Sequence: Synthetic polypeptide
  C-term Free Acid
GYDCLGALRKCIPDNDKCCRPNLVCSRTHRWCKYVFF

SEQ ID NO: 971 - protein, 37 aa, Artificial Sequence
  Description of Artificial Sequence: Synthetic polypeptide
  C-term Free Acid
GLDCLGALRKCIPDNDKCCRPNLVCSRTHRWCKYVFF

SEQ ID NO: 972 - protein, 37 aa, Artificial Sequence
  Description of Artificial Sequence: Synthetic polypeptide
  C-term Free Acid
GVDCLGALRKCIPDNDKCCRPNLVCSRTHRWCKYVFF

SEQ ID NO: 973 - protein, 37 aa, Artificial Sequence
  Description of Artificial Sequence: Synthetic polypeptide
  C-term Free Acid
GIDCLGAFRKCIPDNDKCCRPNLVCSRTHRWCKYVFF

SEQ ID NO: 974 - protein, 37 aa, Artificial Sequence
  Description of Artificial Sequence: Synthetic polypeptide
  C-term Free Acid
GADCLGAFRKCIPDNDKCCRPNLVCSRTHRWCKYVFF

SEQ ID NO: 975 - protein, 37 aa, Artificial Sequence
  Description of Artificial Sequence: Synthetic polypeptide
  C-term Free Acid
GTDCLGAFRKCIPDNDKCCRPNLVCSRTHRWCKYVFF

SEQ ID NO: 976 - protein, 37 aa, Artificial Sequence; identical to SEQ ID NO: 974
  Description of Artificial Sequence: Synthetic polypeptide
  C-term Free Acid

SEQ ID NO: 977 - protein, 37 aa, Artificial Sequence
  Description of Artificial Sequence: Synthetic polypeptide
  C-term Free Acid
GGDCLGAFRKCIPDNDKCCRPNLVCSRTHRWCKYVFF

SEQ ID NO: 978 - protein, 37 aa, Artificial Sequence
  Description of Artificial Sequence: Synthetic polypeptide
  C-term Free Acid
GFDCLGAFRKCIPDNDKCCRPNLVCSRTHRWCKYVFF

SEQ ID NO: 979 - protein, 37 aa, Artificial Sequence
  Description of Artificial Sequence: Synthetic polypeptide
  C-term Free Acid
GYDCLGAFRKCIPDNDKCCRPNLVCSRTHRWCKYVFF

SEQ ID NO: 980 - protein, 37 aa, Artificial Sequence
  Description of Artificial Sequence: Synthetic polypeptide
  C-term Free Acid
GLDCLGAFRKCIPDNDKCCRPNLVCSRTHRWCKYVFF

SEQ ID NO: 981 - protein, 37 aa, Artificial Sequence
  Description of Artificial Sequence: Synthetic polypeptide
  C-term Free Acid
GVDCLGAFRKCIPDNDKCCRPNLVCSRTHRWCKYVFF

SEQ ID NO: 982 - protein, 37 aa, Artificial Sequence
  Description of Artificial Sequence: Synthetic polypeptide
  C-term Free Acid
GADCLGAFRKCIPDGDKCCRPNLVCSRTHRWCKYVFF

SEQ ID NO: 983 - protein, 37 aa, Artificial Sequence
  Description of Artificial Sequence: Synthetic polypeptide
  C-term Free Acid
GADCLGAFRKCIPDSDKCCRPNLVCSRTHRWCKYVFF

SEQ ID NO: 984 - protein, 37 aa, Artificial Sequence
  Description of Artificial Sequence: Synthetic polypeptide
  C-term Free Acid
GADCLGAFRKCIPDIDKCCRPNLVCSRTHRWCKYVFF

SEQ ID NO: 985 - protein, 37 aa, Artificial Sequence
  Description of Artificial Sequence: Synthetic polypeptide
  C-term Free Acid
GADCLGAFRKCIPDLDKCCRPNLVCSRTHRWCKYVFF

SEQ ID NO: 986 - protein, 37 aa, Artificial Sequence
  Description of Artificial Sequence: Synthetic polypeptide
  C-term Free Acid
GADCLGAFRKCIPDMDKCCRPNLVCSRTHRWCKYVFF

SEQ ID NO: 987 - protein, 37 aa, Artificial Sequence
  Description of Artificial Sequence: Synthetic polypeptide
  C-term Free Acid
GADCLGAFRKCIPDVDKCCRPNLVCSRTHRWCKYVFF

SEQ ID NO: 988 - protein, 37 aa, Artificial Sequence
  Description of Artificial Sequence: Synthetic polypeptide
  C-term Free Acid
GADCLGAFRKCIPDTDKCCRPNLVCSRTHRWCKYVFF

SEQ ID NO: 989 - protein, 37 aa, Artificial Sequence
  Description of Artificial Sequence: Synthetic polypeptide
  C-term Free Acid
GADCLGAFRKCIPDFDKCCRPNLVCSRTHRWCKYVFF

SEQ ID NO: 990 - protein, 37 aa, Artificial Sequence
  Description of Artificial Sequence: Synthetic polypeptide
  C-term Free Acid
GADCLGAFRKCIPDYDKCCRPNLVCSRTHRWCKYVFF

SEQ ID NO: 991 - protein, 37 aa, Artificial Sequence
  Description of Artificial Sequence: Synthetic polypeptide
  C-term Free Acid
GADCLGALRKCIPDGDKCCRPNLVCSRTHRWCKYVFF

SEQ ID NO: 992 - protein, 37 aa, Artificial Sequence
  Description of Artificial Sequence: Synthetic polypeptide
  C-term Free Acid
GADCLGALRKCIPDSDKCCRPNLVCSRTHRWCKYVFF

SEQ ID NO: 993 - protein, 37 aa, Artificial Sequence
  Description of Artificial Sequence: Synthetic polypeptide
  C-term Free Acid
GADCLGALRKCIPDIDKCCRPNLVCSRTHRWCKYVFF

SEQ ID NO: 994 - protein, 37 aa, Artificial Sequence
  Description of Artificial Sequence: Synthetic polypeptide
  C-term Free Acid
GADCLGALRKCIPDLDKCCRPNLVCSRTHRWCKYVFF

SEQ ID NO: 995 - protein, 37 aa, Artificial Sequence
  Description of Artificial Sequence: Synthetic polypeptide
  C-term Free Acid
GADCLGALRKCIPDMDKCCRPNLVCSRTHRWCKYVFF

SEQ ID NO: 996 - protein, 37 aa, Artificial Sequence
  Description of Artificial Sequence: Synthetic polypeptide
  C-term Free Acid
GADCLGALRKCIPDVDKCCRPNLVCSRTHRWCKYVFF

SEQ ID NO: 997 - protein, 37 aa, Artificial Sequence
  Description of Artificial Sequence: Synthetic polypeptide
  C-term Free Acid
GADCLGALRKCIPDTDKCCRPNLVCSRTHRWCKYVFF

SEQ ID NO: 998 - protein, 37 aa, Artificial Sequence
  Description of Artificial Sequence: Synthetic polypeptide
  C-term Free Acid
GADCLGALRKCIPDFDKCCRPNLVCSRTHRWCKYVFF

SEQ ID NO: 999 - protein, 37 aa, Artificial Sequence
  Description of Artificial Sequence: Synthetic polypeptide
  C-term Free Acid
GADCLGALRKCIPDYDKCCRPNLVCSRTHRWCKYVFF

SEQ ID NO: 1000 - protein, 37 aa, Artificial Sequence
  Description of Artificial Sequence: Synthetic polypeptide
  C-term Free Acid
GGSCLGALRKCIPDNDKCCRPNLVCSRTHRWCKYVFF

SEQ ID NO: 1001 - protein, 37 aa, Artificial Sequence
  Description of Artificial Sequence: Synthetic polypeptide
  C-term Free Acid
GGWCLGALRKCIPDNDKCCRPNLVCSRTHRWCKYVFF

SEQ ID NO: 1002 - protein, 37 aa, Artificial Sequence
  Description of Artificial Sequence: Synthetic polypeptide
  C-term Free Acid
GGFCLGALRKCIPDNDKCCRPNLVCSRTHRWCKYVFF

SEQ ID NO: 1003 - protein, 37 aa, Artificial Sequence
  Description of Artificial Sequence: Synthetic polypeptide
  C-term Free Acid
GGICLGALRKCIPDNDKCCRPNLVCSRTHRWCKYVFF

SEQ ID NO: 1004 - protein, 38 aa, Artificial Sequence
  Description of Artificial Sequence: Synthetic polypeptide
  C-term Free Acid
GGSSCLGALRKCIPDNDKCCRPNLVCSRTHRWCKYVFF

SEQ ID NO: 1005 - protein, 38 aa, Artificial Sequence
  Description of Artificial Sequence: Synthetic polypeptide
  C-term Free Acid
GGSWCLGALRKCIPDNDKCCRPNLVCSRTHRWCKYVFF

SEQ ID NO: 1006 - protein, 38 aa, Artificial Sequence
  Description of Artificial Sequence: Synthetic polypeptide
  C-term Free Acid
GGSFCLGALRKCIPDNDKCCRPNLVCSRTHRWCKYVFF

SEQ ID NO: 1007 - protein, 38 aa, Artificial Sequence
  Description of Artificial Sequence: Synthetic polypeptide
  C-term Free Acid
GGSICLGALRKCIPDNDKCCRPNLVCSRTHRWCKYVFF

SEQ ID NO: 1008 - protein, 45 aa, Artificial Sequence
  Description of Artificial Sequence: Synthetic polypeptide
  C-term Free Acid
GGGGSGGGGSICLGALRKCIPDADKCCRPNLVCSRTHRWCKYVFF

SEQ ID NO: 1009 - protein, 45 aa, Artificial Sequence
  Description of Artificial Sequence: Synthetic polypeptide
  C-term Free Acid
GGGGSGGGGSFCLGALRKCIPDADKCCRPNLVCSRTHRWCKYVFF

SEQ ID NO: 1010 - protein, 45 aa, Artificial Sequence
  Description of Artificial Sequence: Synthetic polypeptide
  C-term Free Acid
GGGGSGGGGSWCLGALRKCIPDADKCCRPNLVCSRTHRWCKYVFF

SEQ ID NO: 1011 - protein, 45 aa, Artificial Sequence
  Description of Artificial Sequence: Synthetic polypeptide
  C-term Free Acid
GGGGSGGGGSICLGALRKCIPDNDKCCRPNLVCSRTHRWCKYVFF

SEQ ID NO: 1012 - protein, 45 aa, Artificial Sequence
  Description of Artificial Sequence: Synthetic polypeptide
  C-term Free Acid
GGGGSGGGGSFCLGALRKCIPDNDKCCRPNLVCSRTHRWCKYVFF

SEQ ID NO: 1013 - protein, 45 aa, Artificial Sequence
  Description of Artificial Sequence: Synthetic polypeptide
  C-term Free Acid
GGGGSGGGGSWCLGALRKCIPDNDKCCRPNLVCSRTHRWCKYVFF

SEQ ID NO: 1014 - protein, 37 aa, Artificial Sequence
  Description of Artificial Sequence: Synthetic polypeptide
  C-term Free Acid
GGSCLGAFRKCIPDNDKCCRPNLVCSRTHRWCKYVFF

SEQ ID NO: 1015 - protein, 37 aa, Artificial Sequence
  Description of Artificial Sequence: Synthetic polypeptide
  C-term Free Acid
GGWCLGAFRKCIPDNDKCCRPNLVCSRTHRWCKYVFF

SEQ ID NO: 1016 - protein, 37 aa, Artificial Sequence
  Description of Artificial Sequence: Synthetic polypeptide
  C-term Free Acid
GGFCLGAFRKCIPDNDKCCRPNLVCSRTHRWCKYVFF

SEQ ID NO: 1017 - protein, 37 aa, Artificial Sequence
  Description of Artificial Sequence: Synthetic polypeptide
  C-term Free Acid
GGICLGAFRKCIPDNDKCCRPNLVCSRTHRWCKYVFF

SEQ ID NO: 1018 - protein, 38 aa, Artificial Sequence
  Description of Artificial Sequence: Synthetic polypeptide
  C-term Free Acid
GGSSCLGAFRKCIPDNDKCCRPNLVCSRTHRWCKYVFF

SEQ ID NO: 1019 - protein, 38 aa, Artificial Sequence
  Description of Artificial Sequence: Synthetic polypeptide
  C-term Free Acid
GGSWCLGAFRKCIPDNDKCCRPNLVCSRTHRWCKYVFF

SEQ ID NO: 1020 - protein, 38 aa, Artificial Sequence
  Description of Artificial Sequence: Synthetic polypeptide
  C-term Free Acid
GGSFCLGAFRKCIPDNDKCCRPNLVCSRTHRWCKYVFF

SEQ ID NO: 1021 - protein, 38 aa, Artificial Sequence
  Description of Artificial Sequence: Synthetic polypeptide
  C-term Free Acid
GGSICLGAFRKCIPDNDKCCRPNLVCSRTHRWCKYVFF

SEQ ID NO: 1022 - protein, 45 aa, Artificial Sequence
  Description of Artificial Sequence: Synthetic polypeptide
  C-term Free Acid
GGGGSGGGGSICLGAFRKCIPDADKCCRPNLVCSRTHRWCKYVFF

SEQ ID NO: 1023 - protein, 45 aa, Artificial Sequence
  Description of Artificial Sequence: Synthetic polypeptide
  C-term Free Acid
GGGGSGGGGSFCLGAFRKCIPDADKCCRPNLVCSRTHRWCKYVFF

SEQ ID NO: 1024 - protein, 45 aa, Artificial Sequence
  Description of Artificial Sequence: Synthetic polypeptide
  C-term Free Acid
GGGGSGGGGSWCLGAFRKCIPDADKCCRPNLVCSRTHRWCKYVFF

SEQ ID NO: 1025 - protein, 45 aa, Artificial Sequence
  Description of Artificial Sequence: Synthetic polypeptide
  C-term Free Acid
GGGGSGGGGSICLGAFRKCIPDNDKCCRPNLVCSRTHRWCKYVFF

SEQ ID NO: 1026 - protein, 45 aa, Artificial Sequence
  Description of Artificial Sequence: Synthetic polypeptide
  C-term Free Acid
GGGGSGGGGSFCLGAFRKCIPDNDKCCRPNLVCSRTHRWCKYVFF

SEQ ID NO: 1027 - protein, 45 aa, Artificial Sequence
  Description of Artificial Sequence: Synthetic polypeptide
  C-term Free Acid
GGGGSGGGGSWCLGAFRKCIPDNDKCCRPNLVCSRTHRWCKYVFF

SEQ ID NO: 1028 - protein, 34 aa, Artificial Sequence; identical to SEQ ID NO: 520
  Description of Artificial Sequence: Synthetic polypeptide
  MOD_RES (13)..(13): Atz
  C-term Amide

SEQ ID NO: 1029 - protein, 35 aa, Artificial Sequence
  Description of Artificial Sequence: Synthetic polypeptide
  N-term Biotin
  MOD_RES (1)..(1): Ahx
  MOD_RES (6)..(6): 2-Abu
  MOD_RES (14)..(14): 2-Abu
  C-term Amide
XDCLGXLRKCIPDXDKCCRPNLVCSRTHRWCKYVF

SEQ ID NO: 1030 - protein, 34 aa, Artificial Sequence; identical to SEQ ID NO: 798
  Description of Artificial Sequence: Synthetic polypeptide
  MOD_RES (13)..(13): Lys(Biotin)
  C-term Amide

SEQ ID NO: 1031 - protein, 35 aa, Artificial Sequence
  Description of Artificial Sequence: Synthetic polypeptide
  N-term Biotin
  MOD_RES (1)..(1): Ahx
  MOD_RES (14)..(14): Atz
  C-term Amide
XDCLGAFRKCIPDXDKCCRPNLVCSRLHRWCKYVF

SEQ ID NO: 1032 - protein, 34 aa, Artificial Sequence; identical to SEQ ID NO: 22
  Description of Artificial Sequence: Synthetic polypeptide
  N-term DOTA
  C-term Amide

SEQ ID NO: 1033 - protein, 34 aa, Artificial Sequence; identical to SEQ ID NO: 640
  Description of Artificial Sequence: Synthetic polypeptide
  MOD_RES (13)..(13): K(DOTA)
  C-term Amide

SEQ ID NO: 1034 - protein, 34 aa, Artificial Sequence; identical to SEQ ID NO: 640
  Description of Artificial Sequence: Synthetic polypeptide
  MOD_RES (13)..(13): 2-Abu
  C-term Amide

SEQ ID NO: 1035 - protein, 34 aa, Artificial Sequence; identical to SEQ ID NO: 798
  Description of Artificial Sequence: Synthetic polypeptide
  MOD_RES (13)..(13): 2-Abu
  C-term Amide

SEQ ID NO: 1036 - protein, 34 aa, Artificial Sequence; identical to SEQ ID NO: 796
  Description of Artificial Sequence: Synthetic polypeptide
  MOD_RES (13)..(13): 2-Abu
  C-term Amide

SEQ ID NO: 1037 - protein, 34 aa, Artificial Sequence; identical to SEQ ID NO: 640
  Description of Artificial Sequence: Synthetic polypeptide
  MOD_RES (13)..(13): Atz(PEG11-((2-hydroxyethyl)thio)acetamide)
  C-term Amide

SEQ ID NO: 1038 - protein, 34 aa, Artificial Sequence; identical to SEQ ID NO: 640
  Description of Artificial Sequence: Synthetic polypeptide
  MOD_RES (13)..(13): Atz(PEG3-((2-hydroxyethyl)thio)acetamide)
  C-term Amide

SEQ ID NO: 1039 - protein, 34 aa, Artificial Sequence; identical to SEQ ID NO: 798
  Description of Artificial Sequence: Synthetic polypeptide
  MOD_RES (13)..(13): Atz(PEG11-((2-hydroxyethyl)thio)acetamide)
  C-term Amide

SEQ ID NO: 1040 - protein, 34 aa, Artificial Sequence; identical to SEQ ID NO: 798
  Description of Artificial Sequence: Synthetic polypeptide
  MOD_RES (13)..(13): Atz(PEG3-((2-hydroxyethyl)thio)acetamide)
  C-term Amide

SEQ ID NO: 1041 - protein, 34 aa, Artificial Sequence; identical to SEQ ID NO: 759
  Description of Artificial Sequence: Synthetic polypeptide
  N-term ((2-Hydroxyethyl)thio)acetamide-NPEG11-triazole
  MOD_RES (5)..(5): 2-Abu
  MOD_RES (13)..(13): 2-Abu
  C-term Amide

SEQ ID NO: 1042 - protein, 34 aa, Artificial Sequence; identical to SEQ ID NO: 759
  Description of Artificial Sequence: Synthetic polypeptide
  MOD_RES (5)..(5): 2-Abu
  MOD_RES (13)..(13): K(ethyl-triazole-PEG11-((2-hydroxyethyl)thio)acetamide)
  C-term Amide

SEQ ID NO: 1043 - protein, 34 aa, Artificial Sequence; identical to SEQ ID NO: 796
  Description of Artificial Sequence: Synthetic polypeptide
  MOD_RES (13)..(13): Atz(PEG3-((2-hydroxyethyl)thio)acetamide)
  C-term Amide

SEQ ID NO: 1044 - protein, 34 aa, Artificial Sequence; identical to SEQ ID NO: 800
  Description of Artificial Sequence: Synthetic polypeptide
  MOD_RES (13)..(13): Atz(PEG11-((2-hydroxyethyl)thio)acetamide)
  C-term Amide

SEQ ID NO: 1045 - protein, 34 aa, Artificial Sequence; identical to SEQ ID NO: 756
  Description of Artificial Sequence: Synthetic polypeptide
  N-term ((2-Hydroxyethyl)thio)acetamide-NPEG11-triazole
  MOD_RES (13)..(13): 2-Abu
  C-term Amide

SEQ ID NO: 1046 - protein, 34 aa, Artificial Sequence; identical to SEQ ID NO: 640
  Description of Artificial Sequence: Synthetic polypeptide
  MOD_RES (13)..(13): Atz
  C-term Amide

SEQ ID NO: 1047 - protein, 34 aa, Artificial Sequence; identical to SEQ ID NO: 798
  Description of Artificial Sequence: Synthetic polypeptide
  MOD_RES (13)..(13): Atz
  C-term Amide

SEQ ID NO: 1048 - protein, 34 aa, Artificial Sequence; identical to SEQ ID NO: 759
  Description of Artificial Sequence: Synthetic polypeptide
  MOD_RES (5)..(5): 2-Abu
  MOD_RES (13)..(13): 2-Abu
  C-term Amide

SEQ ID NO: 1049 - protein, 34 aa, Artificial Sequence; identical to SEQ ID NO: 515
  Description of Artificial Sequence: Synthetic polypeptide
  MOD_RES (13)..(13): Pra
  C-term Amide

SEQ ID NO: 1050 - protein, 7 aa, Artificial Sequence
  Description of Artificial Sequence: Synthetic peptide
DCLGAFR

SEQ ID NO: 1051-1061 - skipped (11 entries)

SEQ ID NO: 1062 - protein, 34 aa, Artificial Sequence; identical to SEQ ID NO: 640
  Description of Artificial Sequence: Synthetic polypeptide
  MOD_RES (13)..(13): Atz(PEG11-bromoacetamide)
  C-term Amide

SEQ ID NO: 1063 - protein, 34 aa, Artificial Sequence; identical to SEQ ID NO: 640
  Description of Artificial Sequence: Synthetic polypeptide
  MOD_RES (13)..(13): Atz(PEG3-bromoacetamide)
  C-term Amide

SEQ ID NO: 1064 - protein, 34 aa, Artificial Sequence; identical to SEQ ID NO: 798
  Description of Artificial Sequence: Synthetic polypeptide
  MOD_RES (13)..(13): Atz(PEG11-bromoacetamide)
  C-term Amide

SEQ ID NO: 1065 - protein, 34 aa, Artificial Sequence; identical to SEQ ID NO: 798
  Description of Artificial Sequence: Synthetic polypeptide
  MOD_RES (13)..(13): Atz(PEG3-bromoacetamide)
  C-term Amide

SEQ ID NO: 1066 - protein, 34 aa, Artificial Sequence; identical to SEQ ID NO: 759
  Description of Artificial Sequence: Synthetic polypeptide
  N-term bromoacetamide-PEG11-triazole
  MOD_RES (5)..(5): 2-Abu
  MOD_RES (13)..(13): 2-Abu
  C-term Amide

SEQ ID NO: 1067 - protein, 34 aa, Artificial Sequence; identical to SEQ ID NO: 759
  Description of Artificial Sequence: Synthetic polypeptide
  MOD_RES (5)..(5): 2-Abu
  MOD_RES (13)..(13): K(ethyl-triazole-PEG11-bromoacetamide)
  C-term Amide

SEQ ID NO: 1068 - protein, 34 aa, Artificial Sequence; identical to SEQ ID NO: 796
  Description of Artificial Sequence: Synthetic polypeptide
  MOD_RES (13)..(13): Atz(PEG3-bromoacetamide)
  C-term Amide

SEQ ID NO: 1069 - protein, 34 aa, Artificial Sequence; identical to SEQ ID NO: 800
  Description of Artificial Sequence: Synthetic polypeptide
  MOD_RES (13)..(13): Atz(PEG11-bromoacetamide)
  C-term Amide

SEQ ID NO: 1070 - protein, 34 aa, Artificial Sequence; identical to SEQ ID NO: 756
  Description of Artificial Sequence: Synthetic polypeptide
  N-term bromoacetamide-PEG11-triazole
  MOD_RES (13)..(13): 2-Abu
  C-term Amide

SEQ ID NO: 1071 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRTHEWCKYVF

SEQ ID NO: 1072 - protein, 34 aa, Artificial Sequence; identical to SEQ ID NO: 1071
  Description of Artificial Sequence: Synthetic polypeptide
  MOD_RES (13)..(13): Pra
  C-term Amide

SEQ ID NO: 1073 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRLHEWCKYVF

SEQ ID NO: 1074 - protein, 34 aa, Artificial Sequence; identical to SEQ ID NO: 1073
  Description of Artificial Sequence: Synthetic polypeptide
  MOD_RES (13)..(13): Pra
  C-term Amide

SEQ ID NO: 1075 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRTHEWCKYVF

SEQ ID NO: 1076 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRTHEWCKYVF

SEQ ID NO: 1077 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRTHEWCKYVF

SEQ ID NO: 1078 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRTHEWCKYVF

SEQ ID NO: 1079 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRTHEWCKYVF

SEQ ID NO: 1080 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRTHEWCKYVF

SEQ ID NO: 1081 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRTHEWCKYVF

SEQ ID NO: 1082 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRTHEWCKYVF

SEQ ID NO: 1083 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRTHEWCKYVF

SEQ ID NO: 1084 - protein, 34 aa, Artificial Sequence; identical to SEQ ID NO: 1083
  Description of Artificial Sequence: Synthetic polypeptide
  MOD_RES (5)..(5): Nva
  MOD_RES (13)..(13): 2-Abu
  C-term Amide

SEQ ID NO: 1085 - protein, 34 aa, Artificial Sequence; identical to SEQ ID NO: 1083
  Description of Artificial Sequence: Synthetic polypeptide
  MOD_RES (5)..(5): Nle
  MOD_RES (13)..(13): 2-Abu
  C-term Amide

SEQ ID NO: 1086 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRTHEWCKYVF

SEQ ID NO: 1087 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRTHEWCKYVF

SEQ ID NO: 1088 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRTHEWCKYVF

SEQ ID NO: 1089 - protein, 34 aa, Artificial Sequence; identical to SEQ ID NO: 1075
  Description of Artificial Sequence: Synthetic polypeptide
  MOD_RES (13)..(13): Pra
  C-term Amide

SEQ ID NO: 1090 - protein, 34 aa, Artificial Sequence; identical to SEQ ID NO: 1076
  Description of Artificial Sequence: Synthetic polypeptide
  MOD_RES (13)..(13): Pra
  C-term Amide

SEQ ID NO: 1091 - protein, 34 aa, Artificial Sequence; identical to SEQ ID NO: 1077
  Description of Artificial Sequence: Synthetic polypeptide
  MOD_RES (13)..(13): Pra
  C-term Amide

SEQ ID NO: 1092 - protein, 34 aa, Artificial Sequence; identical to SEQ ID NO: 1078
  Description of Artificial Sequence: Synthetic polypeptide
  MOD_RES (13)..(13): Pra
  C-term Amide

SEQ ID NO: 1093 - protein, 34 aa, Artificial Sequence; identical to SEQ ID NO: 1079
  Description of Artificial Sequence: Synthetic polypeptide
  MOD_RES (13)..(13): Pra
  C-term Amide

SEQ ID NO: 1094 - protein, 34 aa, Artificial Sequence; identical to SEQ ID NO: 1080
  Description of Artificial Sequence: Synthetic polypeptide
  MOD_RES (6)..(6): Nle
  MOD_RES (13)..(13): Pra
  C-term Amide

SEQ ID NO: 1095 - protein, 34 aa, Artificial Sequence; identical to SEQ ID NO: 1081
  Description of Artificial Sequence: Synthetic polypeptide
  MOD_RES (13)..(13): Pra
  C-term Amide

SEQ ID NO: 1096 - protein, 34 aa, Artificial Sequence; identical to SEQ ID NO: 1082
  Description of Artificial Sequence: Synthetic polypeptide
  MOD_RES (13)..(13): Pra
  C-term Amide

SEQ ID NO: 1097 - protein, 34 aa, Artificial Sequence; identical to SEQ ID NO: 1083
  Description of Artificial Sequence: Synthetic polypeptide
  MOD_RES (5)..(5): 2-Abu
  MOD_RES (13)..(13): Pra
  C-term Amide

SEQ ID NO: 1098 - protein, 34 aa, Artificial Sequence; identical to SEQ ID NO: 1083
  Description of Artificial Sequence: Synthetic polypeptide
  MOD_RES (5)..(5): Nva
  MOD_RES (13)..(13): Pra
  C-term Amide

SEQ ID NO: 1099 - protein, 34 aa, Artificial Sequence; identical to SEQ ID NO: 1083
  Description of Artificial Sequence: Synthetic polypeptide
  MOD_RES (5)..(5): Nle
  MOD_RES (13)..(13): Pra
  C-term Amide

SEQ ID NO: 1100 - protein, 34 aa, Artificial Sequence; identical to SEQ ID NO: 1086
  Description of Artificial Sequence: Synthetic polypeptide
  MOD_RES (13)..(13): Pra
  C-term Amide

SEQ ID NO: 1101 - protein, 34 aa, Artificial Sequence; identical to SEQ ID NO: 1087
  Description of Artificial Sequence: Synthetic polypeptide
  MOD_RES (13)..(13): Pra
  C-term Amide

SEQ ID NO: 1102 - protein, 34 aa, Artificial Sequence; identical to SEQ ID NO: 1088
  Description of Artificial Sequence: Synthetic polypeptide
  MOD_RES (13)..(13): Pra
  C-term Amide

SEQ ID NO: 1103 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRLHEWCKYVF

SEQ ID NO: 1104 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRLHEWCKYVF

SEQ ID NO: 1105 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRLHEWCKYVF

SEQ ID NO: 1106 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRLHEWCKYVF

SEQ ID NO: 1107 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRLHEWCKYVF

SEQ ID NO: 1108 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRLHEWCKYVF

SEQ ID NO: 1109 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRLHEWCKYVF

SEQ ID NO: 1110 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRLHEWCKYVF

SEQ ID NO: 1111 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRLHEWCKYVF

SEQ ID NO: 1112 - protein, 34 aa, Artificial Sequence; identical to SEQ ID NO: 1111
  Description of Artificial Sequence: Synthetic polypeptide
  MOD_RES (5)..(5): Nva
  MOD_RES (13)..(13): 2-Abu
  C-term Amide

SEQ ID NO: 1113 - protein, 34 aa, Artificial Sequence; identical to SEQ ID NO: 1111
  Description of Artificial Sequence: Synthetic polypeptide
  MOD_RES (5)..(5): Nle
  MOD_RES (13)..(13): 2-Abu
  C-term Amide

SEQ ID NO: 1114 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRLHEWCKYVF

SEQ ID NO: 1115 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRLHEWCKYVF

SEQ ID NO: 1116 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRLHEWCKYVF

SEQ ID NO: 1117 - protein, 34 aa, Artificial Sequence; identical to SEQ ID NO: 1103
  Description of Artificial Sequence: Synthetic polypeptide
  MOD_RES (13)..(13): Pra
  C-term Amide

SEQ ID NO: 1118 - protein, 34 aa, Artificial Sequence; identical to SEQ ID NO: 1104
  Description of Artificial Sequence: Synthetic polypeptide
  MOD_RES (13)..(13): Pra
  C-term Amide

SEQ ID NO: 1119 - protein, 34 aa, Artificial Sequence; identical to SEQ ID NO: 1105
  Description of Artificial Sequence: Synthetic polypeptide
  MOD_RES (13)..(13): Pra
  C-term Amide

SEQ ID NO: 1120 - protein, 34 aa, Artificial Sequence; identical to SEQ ID NO: 1106
  Description of Artificial Sequence: Synthetic polypeptide
  MOD_RES (13)..(13): Pra
  C-term Amide

SEQ ID NO: 1121 - protein, 34 aa, Artificial Sequence; identical to SEQ ID NO: 1107
  Description of Artificial Sequence: Synthetic polypeptide
  MOD_RES (13)..(13): Pra
  C-term Amide

SEQ ID NO: 1122 - protein, 34 aa, Artificial Sequence; identical to SEQ ID NO: 1108
  Description of Artificial Sequence: Synthetic polypeptide
  MOD_RES (6)..(6): Nle
  MOD_RES (13)..(13): Pra
  C-term Amide

SEQ ID NO: 1123 - protein, 34 aa, Artificial Sequence; identical to SEQ ID NO: 1109
  Description of Artificial Sequence: Synthetic polypeptide
  MOD_RES (13)..(13): Pra
  C-term Amide

SEQ ID NO: 1124 - protein, 34 aa, Artificial Sequence; identical to SEQ ID NO: 1110
  Description of Artificial Sequence: Synthetic polypeptide
  MOD_RES (13)..(13): Pra
  C-term Amide

SEQ ID NO: 1125 - protein, 34 aa, Artificial Sequence; identical to SEQ ID NO: 1111
  Description of Artificial Sequence: Synthetic polypeptide
  MOD_RES (5)..(5): 2-Abu
  MOD_RES (13)..(13): Pra
  C-term Amide

SEQ ID NO: 1126 - protein, 34 aa, Artificial Sequence; identical to SEQ ID NO: 1111
  Description of Artificial Sequence: Synthetic polypeptide
  MOD_RES (5)..(5): Nva
  MOD_RES (13)..(13): Pra
  C-term Amide

SEQ ID NO: 1127 - protein, 34 aa, Artificial Sequence; identical to SEQ ID NO: 1111
  Description of Artificial Sequence: Synthetic polypeptide
  MOD_RES (5)..(5): Nle
  MOD_RES (13)..(13): Pra
  C-term Amide

SEQ ID NO: 1128 - protein, 34 aa, Artificial Sequence; identical to SEQ ID NO: 1114
  Description of Artificial Sequence: Synthetic polypeptide
  MOD_RES (13)..(13): Pra
  C-term Amide

SEQ ID NO: 1129 - protein, 34 aa, Artificial Sequence; identical to SEQ ID NO: 1115
  Description of Artificial Sequence: Synthetic polypeptide
  MOD_RES (13)..(13): Pra
  C-term Amide

SEQ ID NO: 1130 - protein, 34 aa, Artificial Sequence; identical to SEQ ID NO: 1116
  Description of Artificial Sequence: Synthetic polypeptide
  MOD_RES (13)..(13): Pra
  C-term Amide

SEQ ID NO: 1131 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRTHEWCKYVF

SEQ ID NO: 1132 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRTHEWCKYVF

SEQ ID NO: 1133 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRTHEWCKYVF

SEQ ID NO: 1134 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRTHEWCKYVF

SEQ ID NO: 1135 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRTHEWCKYVF

SEQ ID NO: 1136 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRTHEWCKYVF

SEQ ID NO: 1137 - protein, 34 aa, Artificial Sequence; identical to SEQ ID NO: 1136
  Description of Artificial Sequence: Synthetic polypeptide
  MOD_RES (5)..(5): Nva
  MOD_RES (13)..(13): 2-Abu
  C-term Amide

SEQ ID NO: 1138 - protein, 34 aa, Artificial Sequence; identical to SEQ ID NO: 1136
  Description of Artificial Sequence: Synthetic polypeptide
  MOD_RES (5)..(5): Nle
  MOD_RES (13)..(13): 2-Abu
  C-term Amide

SEQ ID NO: 1139 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRTHEWCKYVF

SEQ ID NO: 1140 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRTHEWCKYVF

SEQ ID NO: 1141 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRTHEWCKYVF

SEQ ID NO: 1142 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRTHEWCKYVF

SEQ ID NO: 1143 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRTHEWCKYVF

SEQ ID NO: 1144 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRTHEWCKYVF

SEQ ID NO: 1145 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRTHEWCKYVF

SEQ ID NO: 1146 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRTHEWCKYVF

SEQ ID NO: 1147 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRTHEWCKYVF

SEQ ID NO: 1148 - protein, 34 aa, Artificial Sequence; identical to SEQ ID NO: 1147
  Description of Artificial Sequence: Synthetic polypeptide
  MOD_RES (5)..(5): Nva
  MOD_RES (13)..(13): 2-Abu
  C-term Amide

SEQ ID NO: 1149 - protein, 34 aa, Artificial Sequence; identical to SEQ ID NO: 1147
  Description of Artificial Sequence: Synthetic polypeptide
  MOD_RES (5)..(5): Nle
  MOD_RES (13)..(13): 2-Abu
  C-term Amide

SEQ ID NO: 1150 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRTHEWCKYVF

SEQ ID NO: 1151 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRTHEWCKYVF

SEQ ID NO: 1152 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRTHEWCKYVF

SEQ ID NO: 1153 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRTHEWCKYVF

SEQ ID NO: 1154 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRTHEWCKYVF

SEQ ID NO: 1155 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRTHEWCKYVF

SEQ ID NO: 1156 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRTHEWCKYVF

SEQ ID NO: 1157 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRTHEWCKYVF

SEQ ID NO: 1158 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRTHEWCKYVF

SEQ ID NO: 1159 - protein, 34 aa, Artificial Sequence; identical to SEQ ID NO: 1158
  Description of Artificial Sequence: Synthetic polypeptide
  MOD_RES (5)..(5): Nva
  MOD_RES (13)..(13): 2-Abu
  C-term Amide

SEQ ID NO: 1160 - protein, 34 aa, Artificial Sequence; identical to SEQ ID NO: 1158
  Description of Artificial Sequence: Synthetic polypeptide
  MOD_RES (5)..(5): Nle
  MOD_RES (13)..(13): 2-Abu
  C-term Amide

SEQ ID NO: 1161 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRTHEWCKYVF

SEQ ID NO: 1162 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRTHEWCKYVF

SEQ ID NO: 1163 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRTHEWCKYVF

SEQ ID NO: 1164 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRTHEWCKYVF

SEQ ID NO: 1165 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRTHEWCKYVF

SEQ ID NO: 1166 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRTHEWCKYVF

SEQ ID NO: 1167 - protein, 34 aa, Artificial Sequence; identical to SEQ ID NO: 1166
  Description of Artificial Sequence: Synthetic polypeptide
  MOD_RES (5)..(5): Nva
  MOD_RES (13)..(13): 2-Abu
  C-term Amide

SEQ ID NO: 1168 - protein, 34 aa, Artificial Sequence; identical to SEQ ID NO: 1166
  Description of Artificial Sequence: Synthetic polypeptide
  MOD_RES (5)..(5): Nle
  MOD_RES (13)..(13): 2-Abu
  C-term Amide

SEQ ID NO: 1169 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRTHEWCKYVF

SEQ ID NO: 1170 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRTHEWCKYVF

SEQ ID NO: 1171 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRTHEWCKYVF

SEQ ID NO: 1172 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRTHEWCKYVF

SEQ ID NO: 1173 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRTHEWCKYVF

SEQ ID NO: 1174 - protein, 34 aa, Artificial Sequence; identical to SEQ ID NO: 808
  Description of Artificial Sequence: Synthetic polypeptide
  MOD_RES (5)..(5): 2-Abu
  MOD_RES (13)..(13): 2-Abu
  C-term Amide

SEQ ID NO: 1175 - protein, 34 aa, Artificial Sequence; identical to SEQ ID NO: 808
  Description of Artificial Sequence: Synthetic polypeptide
  MOD_RES (5)..(5): Nva
  MOD_RES (13)..(13): 2-Abu
  C-term Amide

SEQ ID NO: 1176 - protein, 34 aa, Artificial Sequence; identical to SEQ ID NO: 808
  Description of Artificial Sequence: Synthetic polypeptide
  MOD_RES (5)..(5): Nle
  MOD_RES (13)..(13): 2-Abu
  C-term Amide

SEQ ID NO: 1177 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRTHEWCKYVF

SEQ ID NO: 1178 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRTHEWCKYVF

SEQ ID NO: 1179 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRTHEWCKYVF

SEQ ID NO: 1180 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRTHEWCKYVF

SEQ ID NO: 1181 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRTHEWCKYVF

SEQ ID NO: 1182 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRTHEWCKYVF

SEQ ID NO: 1183 - protein, 34 aa, Artificial Sequence; identical to SEQ ID NO: 1182
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1184 - protein, 34 aa, Artificial Sequence; identical to SEQ ID NO: 1182
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1185 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRTHEWCKYVF

SEQ ID NO: 1186 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRTHEWCKYVF

SEQ ID NO: 1187 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRTHEWCKYVF

SEQ ID NO: 1188 - protein, 34 aa, Artificial Sequence; identical to SEQ ID NO: 1131
  Description of Artificial Sequence: Synthetic polypeptide
  MOD_RES (13)..(13): Pra
  C-term Amide

SEQ ID NO: 1189 - protein, 34 aa, Artificial Sequence; identical to SEQ ID NO: 1132
  Description of Artificial Sequence: Synthetic polypeptide
  MOD_RES (13)..(13): Pra
  C-term Amide

SEQ ID NO: 1190 - protein, 34 aa, Artificial Sequence; identical to SEQ ID NO: 1133
  Description of Artificial Sequence: Synthetic polypeptide
  MOD_RES (6)..(6): Nle
  MOD_RES (13)..(13): Pra
  C-term Amide

SEQ ID NO: 1191 - protein, 34 aa, Artificial Sequence; identical to SEQ ID NO: 1134
  Description of Artificial Sequence: Synthetic polypeptide
  MOD_RES (13)..(13): Pra
  C-term Amide

SEQ ID NO: 1192 - protein, 34 aa, Artificial Sequence; identical to SEQ ID NO: 1135
  Description of Artificial Sequence: Synthetic polypeptide
  MOD_RES (13)..(13): Pra
  C-term Amide

SEQ ID NO: 1193 - protein, 34 aa, Artificial Sequence; identical to SEQ ID NO: 1136
  Description of Artificial Sequence: Synthetic polypeptide
  MOD_RES (5)..(5): 2-Abu
  MOD_RES (13)..(13): Pra
  C-term Amide

SEQ ID NO: 1194 - protein, 34 aa, Artificial Sequence; identical to SEQ ID NO: 1136
  Description of Artificial Sequence: Synthetic polypeptide
  MOD_RES (5)..(5): Nva
  MOD_RES (13)..(13): Pra
  C-term Amide

SEQ ID NO: 1195 - protein, 34 aa, Artificial Sequence; identical to SEQ ID NO: 1136
  Description of Artificial Sequence: Synthetic polypeptide
  MOD_RES (5)..(5): Nle
  MOD_RES (13)..(13): Pra
  C-term Amide

SEQ ID NO: 1196 - protein, 34 aa, Artificial Sequence; identical to SEQ ID NO: 1139
  Description of Artificial Sequence: Synthetic polypeptide
  MOD_RES (13)..(13): Pra
  C-term Amide

SEQ ID NO: 1197 - protein, 34 aa, Artificial Sequence; identical to SEQ ID NO: 1140
  Description of Artificial Sequence: Synthetic polypeptide
  MOD_RES (13)..(13): Pra
  C-term Amide

SEQ ID NO: 1198 - protein, 34 aa, Artificial Sequence; identical to SEQ ID NO: 1141
  Description of Artificial Sequence: Synthetic polypeptide
  MOD_RES (13)..(13): Pra
  C-term Amide

SEQ ID NO: 1199 - protein, 34 aa, Artificial Sequence; identical to SEQ ID NO: 1142
  Description of Artificial Sequence: Synthetic polypeptide
  MOD_RES (13)..(13): Pra
  C-term Amide

SEQ ID NO: 1200 - protein, 34 aa, Artificial Sequence; identical to SEQ ID NO: 1143
  Description of Artificial Sequence: Synthetic polypeptide
  MOD_RES (13)..(13): Pra
  C-term Amide

SEQ ID NO: 1201 - protein, 34 aa, Artificial Sequence; identical to SEQ ID NO: 1144
  Description of Artificial Sequence: Synthetic polypeptide
  MOD_RES (6)..(6): Nle
  MOD_RES (13)..(13): Pra
  C-term Amide

SEQ ID NO: 1202 - protein, 34 aa, Artificial Sequence; identical to SEQ ID NO: 1145
  Description of Artificial Sequence: Synthetic polypeptide
  MOD_RES (13)..(13): Pra
  C-term Amide

SEQ ID NO: 1203 - protein, 34 aa, Artificial Sequence; identical to SEQ ID NO: 1146
  Description of Artificial Sequence: Synthetic polypeptide
  MOD_RES (13)..(13): Pra
  C-term Amide

SEQ ID NO: 1204 - protein, 34 aa, Artificial Sequence; identical to SEQ ID NO: 1147
  Description of Artificial Sequence: Synthetic polypeptide
  MOD_RES (5)..(5): 2-Abu
  MOD_RES (13)..(13): Pra
  C-term Amide

SEQ ID NO: 1205 - protein, 34 aa, Artificial Sequence; identical to SEQ ID NO: 1147
  Description of Artificial Sequence: Synthetic polypeptide
  MOD_RES (5)..(5): Nva
  MOD_RES (13)..(13): Pra
  C-term Amide

SEQ ID NO: 1206 - protein, 34 aa, Artificial Sequence; identical to SEQ ID NO: 1147
  Description of Artificial Sequence: Synthetic polypeptide
  MOD_RES (5)..(5): Nle
  MOD_RES (13)..(13): Pra
  C-term Amide

SEQ ID NO: 1207 - protein, 34 aa, Artificial Sequence; identical to SEQ ID NO: 1150
  Description of Artificial Sequence: Synthetic polypeptide
  MOD_RES (13)..(13): Pra
  C-term Amide

SEQ ID NO: 1208 - protein, 34 aa, Artificial Sequence; identical to SEQ ID NO: 1151
  Description of Artificial Sequence: Synthetic polypeptide
  MOD_RES (13)..(13): Pra
  C-term Amide

SEQ ID NO: 1209 - protein, 34 aa, Artificial Sequence; identical to SEQ ID NO: 1152
  Description of Artificial Sequence: Synthetic polypeptide
  MOD_RES (13)..(13): Pra
  C-term Amide

SEQ ID NO: 1210 - protein, 34 aa, Artificial Sequence; identical to SEQ ID NO: 1153
  Description of Artificial Sequence: Synthetic polypeptide
  MOD_RES (13)..(13): Pra
  C-term Amide

SEQ ID NO: 1211 - protein, 34 aa, Artificial Sequence; identical to SEQ ID NO: 1154
  Description of Artificial Sequence: Synthetic polypeptide
  MOD_RES (13)..(13): Pra
  C-term Amide

SEQ ID NO: 1212 - protein, 34 aa, Artificial Sequence; identical to SEQ ID NO: 1155
  Description of Artificial Sequence: Synthetic polypeptide
  MOD_RES (6)..(6): Nle
  MOD_RES (13)..(13): Pra
  C-term Amide

SEQ ID NO: 1213 - protein, 34 aa, Artificial Sequence; identical to SEQ ID NO: 1156
  Description of Artificial Sequence: Synthetic polypeptide
  MOD_RES (13)..(13): Pra
  C-term Amide

SEQ ID NO: 1214 - protein, 34 aa, Artificial Sequence; identical to SEQ ID NO: 1157
  Description of Artificial Sequence: Synthetic polypeptide
  MOD_RES (13)..(13): Pra
  C-term Amide

SEQ ID NO: 1215 - protein, 34 aa, Artificial Sequence; identical to SEQ ID NO: 1158
  Description of Artificial Sequence: Synthetic polypeptide
  MOD_RES (5)..(5): 2-Abu
  MOD_RES (13)..(13): Pra
  C-term Amide

SEQ ID NO: 1216 - protein, 34 aa, Artificial Sequence; identical to SEQ ID NO: 1158
  Description of Artificial Sequence: Synthetic polypeptide
  MOD_RES (5)..(5): Nva
  MOD_RES (13)..(13): Pra
  C-term Amide

SEQ ID NO: 1217 - protein, 34 aa, Artificial Sequence; identical to SEQ ID NO: 1158
  Description of Artificial Sequence: Synthetic polypeptide
  MOD_RES (5)..(5): Nle
  MOD_RES (13)..(13): Pra
  C-term Amide

SEQ ID NO: 1218 - protein, 34 aa, Artificial Sequence; identical to SEQ ID NO: 1161
  Description of Artificial Sequence: Synthetic polypeptide
  MOD_RES (13)..(13): Pra
  C-term Amide

SEQ ID NO: 1219 - protein, 34 aa, Artificial Sequence; identical to SEQ ID NO: 1162
  Description of Artificial Sequence: Synthetic polypeptide
  MOD_RES (13)..(13): Pra
  C-term Amide

SEQ ID NO: 1220 - protein, 34 aa, Artificial Sequence; identical to SEQ ID NO: 1163
  Description of Artificial Sequence: Synthetic polypeptide
  MOD_RES (13)..(13): Pra
  C-term Amide

SEQ ID NO: 1221 - protein, 34 aa, Artificial Sequence; identical to SEQ ID NO: 1164
  Description of Artificial Sequence: Synthetic polypeptide
  MOD_RES (13)..(13): Pra
  C-term Amide

SEQ ID NO: 1222 - protein, 34 aa, Artificial Sequence; identical to SEQ ID NO: 1165
  Description of Artificial Sequence: Synthetic polypeptide
  MOD_RES (13)..(13): Pra
  C-term Amide

SEQ ID NO: 1223 - protein, 34 aa, Artificial Sequence; identical to SEQ ID NO: 1166
  Description of Artificial Sequence: Synthetic polypeptide
  MOD_RES (5)..(5): 2-Abu
  MOD_RES (13)..(13): Pra
  C-term Amide

SEQ ID NO: 1224 - protein, 34 aa, Artificial Sequence; identical to SEQ ID NO: 1166
  Description of Artificial Sequence: Synthetic polypeptide
  MOD_RES (5)..(5): Nva
  MOD_RES (13)..(13): Pra
  C-term Amide

SEQ ID NO: 1225 - protein, 34 aa, Artificial Sequence; identical to SEQ ID NO: 1166
  Description of Artificial Sequence: Synthetic polypeptide
  MOD_RES (5)..(5): Nle
  MOD_RES (13)..(13): Pra
  C-term Amide

SEQ ID NO: 1226 - protein, 34 aa, Artificial Sequence; identical to SEQ ID NO: 1169
  Description of Artificial Sequence: Synthetic polypeptide
  MOD_RES (13)..(13): Pra
  C-term Amide

SEQ ID NO: 1227 - protein, 34 aa, Artificial Sequence; identical to SEQ ID NO: 1170
  Description of Artificial Sequence: Synthetic polypeptide
  MOD_RES (13)..(13): Pra
  C-term Amide

SEQ ID NO: 1228 - protein, 34 aa, Artificial Sequence; identical to SEQ ID NO: 1171
  Description of Artificial Sequence: Synthetic polypeptide
  MOD_RES (13)..(13): Pra
  C-term Amide

SEQ ID NO: 1229 - protein, 34 aa, Artificial Sequence; identical to SEQ ID NO: 1172
  Description of Artificial Sequence: Synthetic polypeptide
  MOD_RES (13)..(13): Pra
  C-term Amide

SEQ ID NO: 1230 - protein, 34 aa, Artificial Sequence; identical to SEQ ID NO: 1173
  Description of Artificial Sequence: Synthetic polypeptide
  MOD_RES (13)..(13): Pra
  C-term Amide

SEQ ID NO: 1231 - protein, 34 aa, Artificial Sequence; identical to SEQ ID NO: 808
  Description of Artificial Sequence: Synthetic polypeptide
  MOD_RES (5)..(5): 2-Abu
  MOD_RES (13)..(13): Pra
  C-term Amide

SEQ ID NO: 1232 - protein, 34 aa, Artificial Sequence; identical to SEQ ID NO: 808
  Description of Artificial Sequence: Synthetic polypeptide
  MOD_RES (5)..(5): Nva
  MOD_RES (13)..(13): Pra
  C-term Amide

SEQ ID NO: 1233 - protein, 34 aa, Artificial Sequence; identical to SEQ ID NO: 808
  Description of Artificial Sequence: Synthetic polypeptide
  MOD_RES (5)..(5): Nle
  MOD_RES (13)..(13): Pra
  C-term Amide

SEQ ID NO: 1234 - protein, 34 aa, Artificial Sequence; identical to SEQ ID NO: 1177
  Description of Artificial Sequence: Synthetic polypeptide
  MOD_RES (13)..(13): Pra
  C-term Amide

SEQ ID NO: 1235 - protein, 34 aa, Artificial Sequence; identical to SEQ ID NO: 1178
  Description of Artificial Sequence: Synthetic polypeptide
  MOD_RES (13)..(13): Pra
  C-term Amide

SEQ ID NO: 1236 - protein, 34 aa, Artificial Sequence; identical to SEQ ID NO: 1179
  Description of Artificial Sequence: Synthetic polypeptide
  MOD_RES (13)..(13): Pra
  C-term Amide

SEQ ID NO: 1237 - protein, 34 aa, Artificial Sequence; identical to SEQ ID NO: 1180
  Description of Artificial Sequence: Synthetic polypeptide
  MOD_RES (6)..(6): Nle
  MOD_RES (13)..(13): Pra
  C-term Amide

SEQ ID NO: 1238 - protein, 34 aa, Artificial Sequence; identical to SEQ ID NO: 1181
  Description of Artificial Sequence: Synthetic polypeptide
  MOD_RES (6)..(6): Nle
  MOD_RES (13)..(13): Pra
  C-term Amide

SEQ ID NO: 1239 - protein, 34 aa, Artificial Sequence; identical to SEQ ID NO: 1182
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1240 - protein, 34 aa, Artificial Sequence; identical to SEQ ID NO: 1182
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1241 - protein, 34 aa, Artificial Sequence; identical to SEQ ID NO: 1182
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1242 - protein, 34 aa, Artificial Sequence; identical to SEQ ID NO: 1185
  Description of Artificial Sequence: Synthetic polypeptide
  MOD_RES (6)..(6): Nle
  MOD_RES (13)..(13): Pra
  C-term Amide

SEQ ID NO: 1243 - protein, 34 aa, Artificial Sequence; identical to SEQ ID NO: 1186
  Description of Artificial Sequence: Synthetic polypeptide
  MOD_RES (6)..(6): Nle
  MOD_RES (13)..(13): Pra
  C-term Amide

SEQ ID NO: 1244 - protein, 34 aa, Artificial Sequence; identical to SEQ ID NO: 1187
  Description of Artificial Sequence: Synthetic polypeptide
  MOD_RES (6)..(6): Nle
  MOD_RES (13)..(13): Pra
  C-term Amide

SEQ ID NO: 1245 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRLHEWCKYVF

SEQ ID NO: 1246 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRLHEWCKYVF

SEQ ID NO: 1247 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRLHEWCKYVF

SEQ ID NO: 1248 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRLHEWCKYVF

SEQ ID NO: 1249 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRLHEWCKYVF

SEQ ID NO: 1250 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRLHEWCKYVF

SEQ ID NO: 1251 - protein, 34 aa, Artificial Sequence; identical to SEQ ID NO: 1250
  Description of Artificial Sequence: Synthetic polypeptide
  MOD_RES (5)..(5): Nva
  MOD_RES (13)..(13): 2-Abu
  C-term Amide

SEQ ID NO: 1252 - protein, 34 aa, Artificial Sequence; identical to SEQ ID NO: 1250
  Description of Artificial Sequence: Synthetic polypeptide
  MOD_RES (5)..(5): Nle
  MOD_RES (13)..(13): 2-Abu
  C-term Amide

SEQ ID NO: 1253 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRLHEWCKYVF

SEQ ID NO: 1254 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRLHEWCKYVF

SEQ ID NO: 1255 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRLHEWCKYVF

SEQ ID NO: 1256 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRLHEWCKYVF

SEQ ID NO: 1257 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRLHEWCKYVF

SEQ ID NO: 1258 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRLHEWCKYVF

SEQ ID NO: 1259 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRLHEWCKYVF

SEQ ID NO: 1260 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRLHEWCKYVF

SEQ ID NO: 1261 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRLHEWCKYVF

SEQ ID NO: 1262 - protein, 34 aa, Artificial Sequence; identical to SEQ ID NO: 1261
  Description of Artificial Sequence: Synthetic polypeptide
  MOD_RES (5)..(5): Nva
  MOD_RES (13)..(13): 2-Abu
  C-term Amide

SEQ ID NO: 1263 - protein, 34 aa, Artificial Sequence; identical to SEQ ID NO: 1261
  Description of Artificial Sequence: Synthetic polypeptide
  MOD_RES (5)..(5): Nle
  MOD_RES (13)..(13): 2-Abu
  C-term Amide

SEQ ID NO: 1264 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRLHEWCKYVF

SEQ ID NO: 1265 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRLHEWCKYVF

SEQ ID NO: 1266 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRLHEWCKYVF

SEQ ID NO: 1267 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRLHEWCKYVF

SEQ ID NO: 1268 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRLHEWCKYVF

SEQ ID NO: 1269 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRLHEWCKYVF

SEQ ID NO: 1270 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRLHEWCKYVF

SEQ ID NO: 1271 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRLHEWCKYVF

SEQ ID NO: 1272 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRLHEWCKYVF

SEQ ID NO: 1273 - protein, 34 aa, Artificial Sequence; identical to SEQ ID NO: 1272
  Description of Artificial Sequence: Synthetic polypeptide
  MOD_RES (5)..(5): Nva
  MOD_RES (13)..(13): 2-Abu
  C-term Amide

SEQ ID NO: 1274 - protein, 34 aa, Artificial Sequence; identical to SEQ ID NO: 1272
  Description of Artificial Sequence: Synthetic polypeptide
  MOD_RES (5)..(5): Nle
  MOD_RES (13)..(13): 2-Abu
  C-term Amide

SEQ ID NO: 1275 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRLHEWCKYVF

SEQ ID NO: 1276 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRLHEWCKYVF

SEQ ID NO: 1277 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRLHEWCKYVF

SEQ ID NO: 1278 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRLHEWCKYVF

SEQ ID NO: 1279 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRLHEWCKYVF

SEQ ID NO: 1280 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRLHEWCKYVF

SEQ ID NO: 1281 - protein, 34 aa, Artificial Sequence; identical to SEQ ID NO: 1280
  Description of Artificial Sequence: Synthetic polypeptide
  MOD_RES (5)..(5): Nva
  MOD_RES (13)..(13): 2-Abu
  C-term Amide

SEQ ID NO: 1282 - protein, 34 aa, Artificial Sequence; identical to SEQ ID NO: 1280
  Description of Artificial Sequence: Synthetic polypeptide
  MOD_RES (5)..(5): Nle
  MOD_RES (13)..(13): 2-Abu
  C-term Amide

SEQ ID NO: 1283 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRLHEWCKYVF

SEQ ID NO: 1284 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRLHEWCKYVF

SEQ ID NO: 1285 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRLHEWCKYVF

SEQ ID NO: 1286 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRLHEWCKYVF

SEQ ID NO: 1287 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRLHEWCKYVF

SEQ ID NO: 1288 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSRLHEWCKYVF

SEQ ID NO: 1289 - protein, 34 aa, Artificial Sequence; identical to SEQ ID NO: 1288
  Description of Artificial Sequence: Synthetic polypeptide
  MOD_RES (5)..(5): Nva
  MOD_RES (13)..(13): 2-Abu
  C-term Amide

SEQ ID NO: 1290 - protein, 34 aa, Artificial Sequence; identical to SEQ ID NO: 1288
  Description of Artificial Sequence: Synthetic polypeptide
  MOD_RES (5)..(5): Nle
  MOD_RES (13)..(13): 2-Abu
  C-term Amide

SEQ ID NO: 1291 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRLHEWCKYVF

SEQ ID NO: 1292 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRLHEWCKYVF

SEQ ID NO: 1293 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRLHEWCKYVF

SEQ ID NO: 1294 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRLHEWCKYVF

SEQ ID NO: 1295 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRLHEWCKYVF

SEQ ID NO: 1296 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRLHEWCKYVF

SEQ ID NO: 1297 - protein, 34 aa, Artificial Sequence; identical to SEQ ID NO: 1296
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1298 - protein, 34 aa, Artificial Sequence; identical to SEQ ID NO: 1296
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1299 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRLHEWCKYVF

SEQ ID NO: 1300 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRLHEWCKYVF

SEQ ID NO: 1301 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRLHEWCKYVF

SEQ ID NO: 1302 - protein, 34 aa, Artificial Sequence; identical to SEQ ID NO: 1245
  Description of Artificial Sequence: Synthetic polypeptide
  MOD_RES (13)..(13): Pra
  C-term Amide

SEQ ID NO: 1303 - protein, 34 aa, Artificial Sequence; identical to SEQ ID NO: 1246
  Description of Artificial Sequence: Synthetic polypeptide
  MOD_RES (13)..(13): Pra
  C-term Amide

SEQ ID NO: 1304 - protein, 34 aa, Artificial Sequence; identical to SEQ ID NO: 1247
  Description of Artificial Sequence: Synthetic polypeptide
  MOD_RES (6)..(6): Nle
  MOD_RES (13)..(13): Pra
  C-term Amide

SEQ ID NO: 1305 - protein, 34 aa, Artificial Sequence; identical to SEQ ID NO: 1248
  Description of Artificial Sequence: Synthetic polypeptide
  MOD_RES (13)..(13): Pra
  C-term Amide

SEQ ID NO: 1306 - protein, 34 aa, Artificial Sequence; identical to SEQ ID NO: 1249
  Description of Artificial Sequence: Synthetic polypeptide
  MOD_RES (13)..(13): Pra
  C-term Amide

SEQ ID NO: 1307 - protein, 34 aa, Artificial Sequence; identical to SEQ ID NO: 1250
  Description of Artificial Sequence: Synthetic polypeptide
  MOD_RES (5)..(5): 2-Abu
  MOD_RES (13)..(13): Pra
  C-term Amide

SEQ ID NO: 1308 - protein, 34 aa, Artificial Sequence; identical to SEQ ID NO: 1250
  Description of Artificial Sequence: Synthetic polypeptide
  MOD_RES (5)..(5): Nva
  MOD_RES (13)..(13): Pra
  C-term Amide

SEQ ID NO: 1309 - protein, 34 aa, Artificial Sequence; identical to SEQ ID NO: 1250
  Description of Artificial Sequence: Synthetic polypeptide
  MOD_RES (5)..(5): Nle
  MOD_RES (13)..(13): Pra
  C-term Amide

SEQ ID NO: 1310 - protein, 34 aa, Artificial Sequence; identical to SEQ ID NO: 1253
  Description of Artificial Sequence: Synthetic polypeptide
  MOD_RES (13)..(13): Pra
  C-term Amide

SEQ ID NO: 1311 - protein, 34 aa, Artificial Sequence; identical to SEQ ID NO: 1254
  Description of Artificial Sequence: Synthetic polypeptide
  MOD_RES (13)..(13): Pra
  C-term Amide

SEQ ID NO: 1312 - protein, 34 aa, Artificial Sequence; identical to SEQ ID NO: 1255
  Description of Artificial Sequence: Synthetic polypeptide
  MOD_RES (13)..(13): Pra
  C-term Amide

SEQ ID NO: 1313 - protein, 34 aa, Artificial Sequence; identical to SEQ ID NO: 1256
  Description of Artificial Sequence: Synthetic polypeptide
  MOD_RES (13)..(13): Pra
  C-term Amide

SEQ ID NO: 1314 - protein, 34 aa, Artificial Sequence; identical to SEQ ID NO: 1257
  Description of Artificial Sequence: Synthetic polypeptide
  MOD_RES (13)..(13): Pra
  C-term Amide

SEQ ID NO: 1315 - protein, 34 aa, Artificial Sequence; identical to SEQ ID NO: 1258
  Description of Artificial Sequence: Synthetic polypeptide
  MOD_RES (6)..(6): Nle
  MOD_RES (13)..(13): Pra
  C-term Amide

SEQ ID NO: 1316 - protein, 34 aa, Artificial Sequence; identical to SEQ ID NO: 1259
  Description of Artificial Sequence: Synthetic polypeptide
  MOD_RES (13)..(13): Pra
  C-term Amide

SEQ ID NO: 1317 - protein, 34 aa, Artificial Sequence; identical to SEQ ID NO: 1260
  Description of Artificial Sequence: Synthetic polypeptide
  MOD_RES (13)..(13): Pra
  C-term Amide

SEQ ID NO: 1318 - protein, 34 aa, Artificial Sequence; identical to SEQ ID NO: 1261
  Description of Artificial Sequence: Synthetic polypeptide
  MOD_RES (5)..(5): 2-Abu
  MOD_RES (13)..(13): Pra
  C-term Amide

SEQ ID NO: 1319 - protein, 34 aa, Artificial Sequence; identical to SEQ ID NO: 1261
  Description of Artificial Sequence: Synthetic polypeptide
  MOD_RES (5)..(5): Nva
  MOD_RES (13)..(13): Pra
  C-term Amide

SEQ ID NO: 1320 - protein, 34 aa, Artificial Sequence; identical to SEQ ID NO: 1261
  Description of Artificial Sequence: Synthetic polypeptide
  MOD_RES (5)..(5): Nle
  MOD_RES (13)..(13): Pra
  C-term Amide

SEQ ID NO: 1321 - protein, 34 aa, Artificial Sequence; identical to SEQ ID NO: 1264
  Description of Artificial Sequence: Synthetic polypeptide
  MOD_RES (13)..(13): Pra
  C-term Amide

SEQ ID NO: 1322 - protein, 34 aa, Artificial Sequence; identical to SEQ ID NO: 1265
  Description of Artificial Sequence: Synthetic polypeptide
  MOD_RES (13)..(13): Pra
  C-term Amide

SEQ ID NO: 1323 - protein, 34 aa, Artificial Sequence; identical to SEQ ID NO: 1266
  Description of Artificial Sequence: Synthetic polypeptide
  MOD_RES (13)..(13): Pra
  C-term Amide

SEQ ID NO: 1324 - protein, 34 aa, Artificial Sequence; identical to SEQ ID NO: 1267
  Description of Artificial Sequence: Synthetic polypeptide
  MOD_RES (13)..(13): Pra
  C-term Amide

SEQ ID NO: 1325 - protein, 34 aa, Artificial Sequence; identical to SEQ ID NO: 1268
  Description of Artificial Sequence: Synthetic polypeptide
  MOD_RES (13)..(13): Pra
  C-term Amide

SEQ ID NO: 1326 - protein, 34 aa, Artificial Sequence; identical to SEQ ID NO: 1269
  Description of Artificial Sequence: Synthetic polypeptide
  MOD_RES (6)..(6): Nle
  MOD_RES (13)..(13): Pra
  C-term Amide

SEQ ID NO: 1327 - protein, 34 aa, Artificial Sequence; identical to SEQ ID NO: 1270
  Description of Artificial Sequence: Synthetic polypeptide
  MOD_RES (13)..(13): Pra
  C-term Amide

SEQ ID NO: 1328 - protein, 34 aa, Artificial Sequence; identical to SEQ ID NO: 1271
  Description of Artificial Sequence: Synthetic polypeptide
  MOD_RES (13)..(13): Pra
  C-term Amide

SEQ ID NO: 1329 - protein, 34 aa, Artificial Sequence; identical to SEQ ID NO: 1272
  Description of Artificial Sequence: Synthetic polypeptide
  MOD_RES (5)..(5): 2-Abu
  MOD_RES (13)..(13): Pra
  C-term Amide

SEQ ID NO: 1330 - protein, 34 aa, Artificial Sequence; identical to SEQ ID NO: 1272
  Description of Artificial Sequence: Synthetic polypeptide
  MOD_RES (5)..(5): Nva
  MOD_RES (13)..(13): Pra
  C-term Amide

SEQ ID NO: 1331 - protein, 34 aa, Artificial Sequence; identical to SEQ ID NO: 1272
  Description of Artificial Sequence: Synthetic polypeptide
  MOD_RES (5)..(5): Nle
  MOD_RES (13)..(13): Pra
  C-term Amide

SEQ ID NO: 1332 - protein, 34 aa, Artificial Sequence; identical to SEQ ID NO: 1275
  Description of Artificial Sequence: Synthetic polypeptide
  MOD_RES (13)..(13): Pra
  C-term Amide

SEQ ID NO: 1333 - protein, 34 aa, Artificial Sequence; identical to SEQ ID NO: 1276
  Description of Artificial Sequence: Synthetic polypeptide
  MOD_RES (13)..(13): Pra
  C-term Amide

SEQ ID NO: 1334 - protein, 34 aa, Artificial Sequence; identical to SEQ ID NO: 1277
  Description of Artificial Sequence: Synthetic polypeptide
  MOD_RES (13)..(13): Pra
  C-term Amide

SEQ ID NO: 1335 - protein, 34 aa, Artificial Sequence; identical to SEQ ID NO: 1278
  Description of Artificial Sequence: Synthetic polypeptide
  MOD_RES (13)..(13): Pra
  C-term Amide

SEQ ID NO: 1336 - protein, 34 aa, Artificial Sequence; identical to SEQ ID NO: 1279
  Description of Artificial Sequence: Synthetic polypeptide
  MOD_RES (13)..(13): Pra
  C-term Amide

SEQ ID NO: 1337 - protein, 34 aa, Artificial Sequence; identical to SEQ ID NO: 1280
  Description of Artificial Sequence: Synthetic polypeptide
  MOD_RES (5)..(5): 2-Abu
  MOD_RES (13)..(13): Pra
  C-term Amide

SEQ ID NO: 1338 - protein, 34 aa, Artificial Sequence; identical to SEQ ID NO: 1280
  Description of Artificial Sequence: Synthetic polypeptide
  MOD_RES (5)..(5): Nva
  MOD_RES (13)..(13): Pra
  C-term Amide

SEQ ID NO: 1339 - protein, 34 aa, Artificial Sequence; identical to SEQ ID NO: 1280
  Description of Artificial Sequence: Synthetic polypeptide
  MOD_RES (5)..(5): Nle
  MOD_RES (13)..(13): Pra
  C-term Amide

SEQ ID NO: 1340 - protein, 34 aa, Artificial Sequence; identical to SEQ ID NO: 1283
  Description of Artificial Sequence: Synthetic polypeptide
  MOD_RES (13)..(13): Pra
  C-term Amide

SEQ ID NO: 1341 - protein, 34 aa, Artificial Sequence; identical to SEQ ID NO: 1284
  Description of Artificial Sequence: Synthetic polypeptide
  MOD_RES (13)..(13): Pra
  C-term Amide

SEQ ID NO: 1342 - protein, 34 aa, Artificial Sequence; identical to SEQ ID NO: 1285
  Description of Artificial Sequence: Synthetic polypeptide
  MOD_RES (13)..(13): Pra
  C-term Amide

SEQ ID NO: 1343 - protein, 34 aa, Artificial Sequence; identical to SEQ ID NO: 1286
  Description of Artificial Sequence: Synthetic polypeptide
  MOD_RES (13)..(13): Pra
  C-term Amide

SEQ ID NO: 1344 - protein, 34 aa, Artificial Sequence; identical to SEQ ID NO: 1287
  Description of Artificial Sequence: Synthetic polypeptide
  MOD_RES (13)..(13): Pra
  C-term Amide

SEQ ID NO: 1345 - protein, 34 aa, Artificial Sequence; identical to SEQ ID NO: 1288
  Description of Artificial Sequence: Synthetic polypeptide
  MOD_RES (5)..(5): 2-Abu
  MOD_RES (13)..(13): Pra
  C-term Amide

SEQ ID NO: 1346 - protein, 34 aa, Artificial Sequence; identical to SEQ ID NO: 1288
  Description of Artificial Sequence: Synthetic polypeptide
  MOD_RES (5)..(5): Nva
  MOD_RES (13)..(13): Pra
  C-term Amide

SEQ ID NO: 1347 - protein, 34 aa, Artificial Sequence; identical to SEQ ID NO: 1288
  Description of Artificial Sequence: Synthetic polypeptide
  MOD_RES (5)..(5): Nle
  MOD_RES (13)..(13): Pra
  C-term Amide

SEQ ID NO: 1348 - protein, 34 aa, Artificial Sequence; identical to SEQ ID NO: 1291
  Description of Artificial Sequence: Synthetic polypeptide
  MOD_RES (13)..(13): Pra
  C-term Amide

SEQ ID NO: 1349 - protein, 34 aa, Artificial Sequence; identical to SEQ ID NO: 1292
  Description of Artificial Sequence: Synthetic polypeptide
  MOD_RES (13)..(13): Pra
  C-term Amide

SEQ ID NO: 1350 - protein, 34 aa, Artificial Sequence; identical to SEQ ID NO: 1293
  Description of Artificial Sequence: Synthetic polypeptide
  MOD_RES (13)..(13): Pra
  C-term Amide

SEQ ID NO: 1351 - protein, 34 aa, Artificial Sequence; identical to SEQ ID NO: 1294
  Description of Artificial Sequence: Synthetic polypeptide
  MOD_RES (6)..(6): Nle
  MOD_RES (13)..(13): Pra
  C-term Amide

SEQ ID NO: 1352 - protein, 34 aa, Artificial Sequence; identical to SEQ ID NO: 1295
  Description of Artificial Sequence: Synthetic polypeptide
  MOD_RES (6)..(6): Nle
  MOD_RES (13)..(13): Pra
  C-term Amide

SEQ ID NO: 1353 - protein, 34 aa, Artificial Sequence; identical to SEQ ID NO: 1296
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1354 - protein, 34 aa, Artificial Sequence; identical to SEQ ID NO: 1296
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1355 - protein, 34 aa, Artificial Sequence; identical to SEQ ID NO: 1296
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1356 - protein, 34 aa, Artificial Sequence; identical to SEQ ID NO: 1299
  Description of Artificial Sequence: Synthetic polypeptide
  MOD_RES (6)..(6): Nle
  MOD_RES (13)..(13): Pra
  C-term Amide

SEQ ID NO: 1357 - protein, 34 aa, Artificial Sequence; identical to SEQ ID NO: 1300
  Description of Artificial Sequence: Synthetic polypeptide
  MOD_RES (6)..(6): Nle
  MOD_RES (13)..(13): Pra
  C-term Amide

SEQ ID NO: 1358 - protein, 34 aa, Artificial Sequence; identical to SEQ ID NO: 1301
  Description of Artificial Sequence: Synthetic polypeptide
  MOD_RES (6)..(6): Nle
  MOD_RES (13)..(13): Pra
  C-term Amide

SEQ ID NO: 1359 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRTHEWCKYVF

SEQ ID NO: 1360 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRTHEWCKYVF

SEQ ID NO: 1361 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRTHEWCKYVF

SEQ ID NO: 1362 - protein, 34 aa, Artificial Sequence; identical to SEQ ID NO: 1361
  Description of Artificial Sequence: Synthetic polypeptide
  MOD_RES (5)..(5): Nva
  MOD_RES (13)..(13): 2-Abu
  C-term Amide

SEQ ID NO: 1363 - protein, 34 aa, Artificial Sequence; identical to SEQ ID NO: 1361
  Description of Artificial Sequence: Synthetic polypeptide
  MOD_RES (5)..(5): Nle
  MOD_RES (13)..(13): 2-Abu
  C-term Amide

SEQ ID NO: 1364 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRTHEWCKYVF

SEQ ID NO: 1365 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRTHEWCKYVF

SEQ ID NO: 1366 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRTHEWCKYVF

SEQ ID NO: 1367 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRTHEWCKYVF

SEQ ID NO: 1368 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRTHEWCKYVF

SEQ ID NO: 1369 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRTHEWCKYVF

SEQ ID NO: 1370 - protein, 34 aa, Artificial Sequence; identical to SEQ ID NO: 1369
  Description of Artificial Sequence: Synthetic polypeptide
  MOD_RES (5)..(5): Nva
  MOD_RES (13)..(13): 2-Abu
  C-term Amide

SEQ ID NO: 1371 - protein, 34 aa, Artificial Sequence; identical to SEQ ID NO: 1369
  Description of Artificial Sequence: Synthetic polypeptide
  MOD_RES (5)..(5): Nle
  MOD_RES (13)..(13): 2-Abu
  C-term Amide

SEQ ID NO: 1372 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRTHEWCKYVF

SEQ ID NO: 1373 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRTHEWCKYVF

SEQ ID NO: 1374 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRTHEWCKYVF

SEQ ID NO: 1375 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRTHEWCKYVF

SEQ ID NO: 1376 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRTHEWCKYVF

SEQ ID NO: 1377 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRTHEWCKYVF

SEQ ID NO: 1378 - protein, 34 aa, Artificial Sequence; identical to SEQ ID NO: 1377
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1379 - protein, 34 aa, Artificial Sequence; identical to SEQ ID NO: 1377
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1380 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRTHEWCKYVF

SEQ ID NO: 1381 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRTHEWCKYVF

SEQ ID NO: 1382 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRTHEWCKYVF

SEQ ID NO: 1383 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRTHEWCKYVF

SEQ ID NO: 1384 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRTHEWCKYVF

SEQ ID NO: 1385 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRTHEWCKYVF

SEQ ID NO: 1386 - protein, 34 aa, Artificial Sequence; identical to SEQ ID NO: 1385
  Description of Artificial Sequence: Synthetic polypeptide
  MOD_RES (5)..(5): Nva
  MOD_RES (13)..(13): 2-Abu
  C-term Amide

SEQ ID NO: 1387 - protein, 34 aa, Artificial Sequence; identical to SEQ ID NO: 1385
  Description of Artificial Sequence: Synthetic polypeptide
  MOD_RES (5)..(5): Nle
  MOD_RES (13)..(13): 2-Abu
  C-term Amide

SEQ ID NO: 1388 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRTHEWCKYVF

SEQ ID NO: 1389 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRTHEWCKYVF

SEQ ID NO: 1390 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRTHEWCKYVF

SEQ ID NO: 1391 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRTHEWCKYVF

SEQ ID NO: 1392 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRTHEWCKYVF

SEQ ID NO: 1393 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRTHEWCKYVF

SEQ ID NO: 1394 - protein, 34 aa, Artificial Sequence; identical to SEQ ID NO: 1393
  Description of Artificial Sequence: Synthetic polypeptide
  MOD_RES (5)..(5): Nva
  MOD_RES (13)..(13): 2-Abu
  C-term Amide

SEQ ID NO: 1395 - protein, 34 aa, Artificial Sequence; identical to SEQ ID NO: 1393
  Description of Artificial Sequence: Synthetic polypeptide
  MOD_RES (5)..(5): Nle
  MOD_RES (13)..(13): 2-Abu
  C-term Amide

SEQ ID NO: 1396 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRTHEWCKYVF

SEQ ID NO: 1397 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRTHEWCKYVF

SEQ ID NO: 1398 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRTHEWCKYVF

SEQ ID NO: 1399 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRTHEWCKYVF

SEQ ID NO: 1400 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRTHEWCKYVF

SEQ ID NO: 1401 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRTHEWCKYVF

SEQ ID NO: 1402 - protein, 34 aa, Artificial Sequence; identical to SEQ ID NO: 1401
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1403 - protein, 34 aa, Artificial Sequence; identical to SEQ ID NO: 1401
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1404 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRTHEWCKYVF

SEQ ID NO: 1405 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRTHEWCKYVF

SEQ ID NO: 1406 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRTHEWCKYVF

SEQ ID NO: 1407 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRTHEWCKYVF

SEQ ID NO: 1408 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRTHEWCKYVF

SEQ ID NO: 1409 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRTHEWCKYVF

SEQ ID NO: 1410 - protein, 34 aa, Artificial Sequence; identical to SEQ ID NO: 1409
  Description of Artificial Sequence: Synthetic polypeptide
  MOD_RES (5)..(5): Nva
  MOD_RES (13)..(13): 2-Abu
  C-term Amide

SEQ ID NO: 1411 - protein, 34 aa, Artificial Sequence; identical to SEQ ID NO: 1409
  Description of Artificial Sequence: Synthetic polypeptide
  MOD_RES (5)..(5): Nle
  MOD_RES (13)..(13): 2-Abu
  C-term Amide

SEQ ID NO: 1412 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRTHEWCKYVF

SEQ ID NO: 1413 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRTHEWCKYVF

SEQ ID NO: 1414 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRTHEWCKYVF

SEQ ID NO: 1415 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRTHEWCKYVF

SEQ ID NO: 1416 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRTHEWCKYVF

SEQ ID NO: 1417 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRTHEWCKYVF

SEQ ID NO: 1418 - protein, 34 aa, Artificial Sequence; identical to SEQ ID NO: 1417
  Description of Artificial Sequence: Synthetic polypeptide
  MOD_RES (5)..(5): Nva
  MOD_RES (13)..(13): 2-Abu
  C-term Amide

SEQ ID NO: 1419 - protein, 34 aa, Artificial Sequence; identical to SEQ ID NO: 1417
  Description of Artificial Sequence: Synthetic polypeptide
  MOD_RES (5)..(5): Nle
  MOD_RES (13)..(13): 2-Abu
  C-term Amide

SEQ ID NO: 1420 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRTHEWCKYVF

SEQ ID NO: 1421 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRTHEWCKYVF

SEQ ID NO: 1422 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRTHEWCKYVF

SEQ ID NO: 1423 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRTHEWCKYVF

SEQ ID NO: 1424 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRTHEWCKYVF

SEQ ID NO: 1425 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRTHEWCKYVF

SEQ ID NO: 1426 - protein, 34 aa, Artificial Sequence; identical to SEQ ID NO: 1425
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1427 - protein, 34 aa, Artificial Sequence; identical to SEQ ID NO: 1425
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1428 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRTHEWCKYVF

SEQ ID NO: 1429 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRTHEWCKYVF

SEQ ID NO: 1430 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRTHEWCKYVF

SEQ ID NO: 1431 - protein, 34 aa, Artificial Sequence; identical to SEQ ID NO: 1359
  Description of Artificial Sequence: Synthetic polypeptide
  MOD_RES (13)..(13): Pra
  C-term Amide

SEQ ID NO: 1432 - protein, 34 aa, Artificial Sequence; identical to SEQ ID NO: 1360
  Description of Artificial Sequence: Synthetic polypeptide
  MOD_RES (13)..(13): Pra
  C-term Amide

SEQ ID NO: 1433 - protein, 34 aa, Artificial Sequence; identical to SEQ ID NO: 1361
  Description of Artificial Sequence: Synthetic polypeptide
  MOD_RES (5)..(5): 2-Abu
  MOD_RES (13)..(13): Pra
  C-term Amide

SEQ ID NO: 1434 - protein, 34 aa, Artificial Sequence; identical to SEQ ID NO: 1361
  Description of Artificial Sequence: Synthetic polypeptide
  MOD_RES (5)..(5): Nva
  MOD_RES (13)..(13): Pra
  C-term Amide

SEQ ID NO: 1435 - protein, 34 aa, Artificial Sequence; identical to SEQ ID NO: 1361
  Description of Artificial Sequence: Synthetic polypeptide
  MOD_RES (5)..(5): Nle
  MOD_RES (13)..(13): Pra
  C-term Amide

SEQ ID NO: 1436 - protein, 34 aa, Artificial Sequence; identical to SEQ ID NO: 1364
  Description of Artificial Sequence: Synthetic polypeptide
  MOD_RES (13)..(13): Pra
  C-term Amide

SEQ ID NO: 1437 - protein, 34 aa, Artificial Sequence; identical to SEQ ID NO: 1365
  Description of Artificial Sequence: Synthetic polypeptide
  MOD_RES (13)..(13): Pra
  C-term Amide

SEQ ID NO: 1438 - protein, 34 aa, Artificial Sequence; identical to SEQ ID NO: 1366
  Description of Artificial Sequence: Synthetic polypeptide
  MOD_RES (13)..(13): Pra
  C-term Amide

SEQ ID NO: 1439 - protein, 34 aa, Artificial Sequence; identical to SEQ ID NO: 1367
  Description of Artificial Sequence: Synthetic polypeptide
  MOD_RES (13)..(13): Pra
  C-term Amide

SEQ ID NO: 1440 - protein, 34 aa, Artificial Sequence; identical to SEQ ID NO: 1368
  Description of Artificial Sequence: Synthetic polypeptide
  MOD_RES (13)..(13): Pra
  C-term Amide

SEQ ID NO: 1441 - protein, 34 aa, Artificial Sequence; identical to SEQ ID NO: 1369
  Description of Artificial Sequence: Synthetic polypeptide
  MOD_RES (5)..(5): 2-Abu
  MOD_RES (13)..(13): Pra
  C-term Amide

SEQ ID NO: 1442 - protein, 34 aa, Artificial Sequence; identical to SEQ ID NO: 1369
  Description of Artificial Sequence: Synthetic polypeptide
  MOD_RES (5)..(5): Nva
  MOD_RES (13)..(13): Pra
  C-term Amide

SEQ ID NO: 1443 - protein, 34 aa, Artificial Sequence; identical to SEQ ID NO: 1369
  Description of Artificial Sequence: Synthetic polypeptide
  MOD_RES (5)..(5): Nle
  MOD_RES (13)..(13): Pra
  C-term Amide

SEQ ID NO: 1444 - protein, 34 aa, Artificial Sequence; identical to SEQ ID NO: 1372
  Description of Artificial Sequence: Synthetic polypeptide
  MOD_RES (13)..(13): Pra
  C-term Amide

SEQ ID NO: 1445 - protein, 34 aa, Artificial Sequence; identical to SEQ ID NO: 1373
  Description of Artificial Sequence: Synthetic polypeptide
  MOD_RES (13)..(13): Pra
  C-term Amide

SEQ ID NO: 1446 - protein, 34 aa, Artificial Sequence; identical to SEQ ID NO: 1374
  Description of Artificial Sequence: Synthetic polypeptide
  MOD_RES (13)..(13): Pra
  C-term Amide

SEQ ID NO: 1447 - protein, 34 aa, Artificial Sequence; identical to SEQ ID NO: 1375
  Description of Artificial Sequence: Synthetic polypeptide
  MOD_RES (6)..(6): Nle
  MOD_RES (13)..(13): Pra
  C-term Amide

SEQ ID NO: 1448 - protein, 34 aa, Artificial Sequence; identical to SEQ ID NO: 1376
  Description of Artificial Sequence: Synthetic polypeptide
  MOD_RES (6)..(6): Nle
  MOD_RES (13)..(13): Pra
  C-term Amide

SEQ ID NO: 1449 - protein, 34 aa, Artificial Sequence; identical to SEQ ID NO: 1377
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1450 - protein, 34 aa, Artificial Sequence; identical to SEQ ID NO: 1377
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1451 - protein, 34 aa, Artificial Sequence; identical to SEQ ID NO: 1377
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1452 - protein, 34 aa, Artificial Sequence; identical to SEQ ID NO: 1380
  Description of Artificial Sequence: Synthetic polypeptide
  MOD_RES (6)..(6): Nle
  MOD_RES (13)..(13): Pra
  C-term Amide

SEQ ID NO: 1453 - protein, 34 aa, Artificial Sequence; identical to SEQ ID NO: 1381
  Description of Artificial Sequence: Synthetic polypeptide
  MOD_RES (6)..(6): Nle
  MOD_RES (13)..(13): Pra
  C-term Amide

SEQ ID NO: 1454 - protein, 34 aa, Artificial Sequence; identical to SEQ ID NO: 1382
  Description of Artificial Sequence: Synthetic polypeptide
  MOD_RES (6)..(6): Nle
  MOD_RES (13)..(13): Pra
  C-term Amide

SEQ ID NO: 1455 - protein, 34 aa, Artificial Sequence; identical to SEQ ID NO: 1383
  Description of Artificial Sequence: Synthetic polypeptide
  MOD_RES (13)..(13): Pra
  C-term Amide

SEQ ID NO: 1456 - protein, 34 aa, Artificial Sequence; identical to SEQ ID NO: 1384
  Description of Artificial Sequence: Synthetic polypeptide
  MOD_RES (13)..(13): Pra
  C-term Amide

SEQ ID NO: 1457 - protein, 34 aa, Artificial Sequence; identical to SEQ ID NO: 1385
  Description of Artificial Sequence: Synthetic polypeptide
  MOD_RES (5)..(5): 2-Abu
  MOD_RES (13)..(13): Pra
  C-term Amide

SEQ ID NO: 1458 - protein, 34 aa, Artificial Sequence; identical to SEQ ID NO: 1385
  Description of Artificial Sequence: Synthetic polypeptide
  MOD_RES (5)..(5): Nva
  MOD_RES (13)..(13): Pra
  C-term Amide

SEQ ID NO: 1459 - protein, 34 aa, Artificial Sequence; identical to SEQ ID NO: 1385
  Description of Artificial Sequence: Synthetic polypeptide
  MOD_RES (5)..(5): Nle
  MOD_RES (13)..(13): Pra
  C-term Amide

SEQ ID NO: 1460 - protein, 34 aa, Artificial Sequence; identical to SEQ ID NO: 1388
  Description of Artificial Sequence: Synthetic polypeptide
  MOD_RES (13)..(13): Pra
  C-term Amide

SEQ ID NO: 1461 - protein, 34 aa, Artificial Sequence; identical to SEQ ID NO: 1389
  Description of Artificial Sequence: Synthetic polypeptide
  MOD_RES (13)..(13): Pra
  C-term Amide

SEQ ID NO: 1462 - protein, 34 aa, Artificial Sequence; identical to SEQ ID NO: 1390
  Description of Artificial Sequence: Synthetic polypeptide
  MOD_RES (13)..(13): Pra
  C-term Amide

SEQ ID NO: 1463 - protein, 34 aa, Artificial Sequence; identical to SEQ ID NO: 1391
  Description of Artificial Sequence: Synthetic polypeptide
  MOD_RES (13)..(13): Pra
  C-term Amide

SEQ ID NO: 1464 - protein, 34 aa, Artificial Sequence; identical to SEQ ID NO: 1392
  Description of Artificial Sequence: Synthetic polypeptide
  MOD_RES (13)..(13): Pra
  C-term Amide

SEQ ID NO: 1465 - protein, 34 aa, Artificial Sequence; identical to SEQ ID NO: 1393
  Description of Artificial Sequence: Synthetic polypeptide
  MOD_RES (5)..(5): 2-Abu
  MOD_RES (13)..(13): Pra
  C-term Amide

SEQ ID NO: 1466 - protein, 34 aa, Artificial Sequence; identical to SEQ ID NO: 1393
  Description of Artificial Sequence: Synthetic polypeptide
  MOD_RES (5)..(5): Nva
  MOD_RES (13)..(13): Pra
  C-term Amide

SEQ ID NO: 1467 - protein, 34 aa, Artificial Sequence; identical to SEQ ID NO: 1393
  Description of Artificial Sequence: Synthetic polypeptide
  MOD_RES (5)..(5): Nle
  MOD_RES (13)..(13): Pra
  C-term Amide

SEQ ID NO: 1468 - protein, 34 aa, Artificial Sequence; identical to SEQ ID NO: 1396
  Description of Artificial Sequence: Synthetic polypeptide
  MOD_RES (13)..(13): Pra
  C-term Amide

SEQ ID NO: 1469 - protein, 34 aa, Artificial Sequence; identical to SEQ ID NO: 1397
  Description of Artificial Sequence: Synthetic polypeptide
  MOD_RES (13)..(13): Pra
  C-term Amide

SEQ ID NO: 1470 - protein, 34 aa, Artificial Sequence; identical to SEQ ID NO: 1398
  Description of Artificial Sequence: Synthetic polypeptide
  MOD_RES (13)..(13): Pra
  C-term Amide

SEQ ID NO: 1471 - protein, 34 aa, Artificial Sequence; identical to SEQ ID NO: 1399
  Description of Artificial Sequence: Synthetic polypeptide
  MOD_RES (6)..(6): Nle
  MOD_RES (13)..(13): Pra
  C-term Amide

SEQ ID NO: 1472 - protein, 34 aa, Artificial Sequence; identical to SEQ ID NO: 1400
  Description of Artificial Sequence: Synthetic polypeptide
  MOD_RES (6)..(6): Nle
  MOD_RES (13)..(13): Pra
  C-term Amide

SEQ ID NO: 1473 - protein, 34 aa, Artificial Sequence; identical to SEQ ID NO: 1401
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1474 - protein, 34 aa, Artificial Sequence; identical to SEQ ID NO: 1401
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1475 - protein, 34 aa, Artificial Sequence; identical to SEQ ID NO: 1401
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1476 - protein, 34 aa, Artificial Sequence; identical to SEQ ID NO: 1404
  Description of Artificial Sequence: Synthetic polypeptide
  MOD_RES (6)..(6): Nle
  MOD_RES (13)..(13): Pra
  C-term Amide

SEQ ID NO: 1477 - protein, 34 aa, Artificial Sequence; identical to SEQ ID NO: 1405
  Description of Artificial Sequence: Synthetic polypeptide
  MOD_RES (6)..(6): Nle
  MOD_RES (13)..(13): Pra
  C-term Amide

SEQ ID NO: 1478 - protein, 34 aa, Artificial Sequence; identical to SEQ ID NO: 1406
  Description of Artificial Sequence: Synthetic polypeptide
  MOD_RES (6)..(6): Nle
  MOD_RES (13)..(13): Pra
  C-term Amide

SEQ ID NO: 1479 - protein, 34 aa, Artificial Sequence; identical to SEQ ID NO: 1407
  Description of Artificial Sequence: Synthetic polypeptide
  MOD_RES (13)..(13): Pra
  C-term Amide

SEQ ID NO: 1480 - protein, 34 aa, Artificial Sequence; identical to SEQ ID NO: 1408
  Description of Artificial Sequence: Synthetic polypeptide
  MOD_RES (13)..(13): Pra
  C-term Amide

SEQ ID NO: 1481 - protein, 34 aa, Artificial Sequence; identical to SEQ ID NO: 1409
  Description of Artificial Sequence: Synthetic polypeptide
  MOD_RES (5)..(5): 2-Abu
  MOD_RES (13)..(13): Pra
  C-term Amide

SEQ ID NO: 1482 - protein, 34 aa, Artificial Sequence; identical to SEQ ID NO: 1409
  Description of Artificial Sequence: Synthetic polypeptide
  MOD_RES (5)..(5): Nva
  MOD_RES (13)..(13): Pra
  C-term Amide

SEQ ID NO: 1483 - protein, 34 aa, Artificial Sequence; identical to SEQ ID NO: 1409
  Description of Artificial Sequence: Synthetic polypeptide
  MOD_RES (5)..(5): Nle
  MOD_RES (13)..(13): Pra
  C-term Amide

SEQ ID NO: 1484 - protein, 34 aa, Artificial Sequence; identical to SEQ ID NO: 1412
  Description of Artificial Sequence: Synthetic polypeptide
  MOD_RES (13)..(13): Pra
  C-term Amide

SEQ ID NO: 1485 - protein, 34 aa, Artificial Sequence; identical to SEQ ID NO: 1413
  Description of Artificial Sequence: Synthetic polypeptide
  MOD_RES (13)..(13): Pra
  C-term Amide

SEQ ID NO: 1486 - protein, 34 aa, Artificial Sequence; identical to SEQ ID NO: 1414
  Description of Artificial Sequence: Synthetic polypeptide
  MOD_RES (13)..(13): Pra
  C-term Amide

SEQ ID NO: 1487 - protein, 34 aa, Artificial Sequence; identical to SEQ ID NO: 1415
  Description of Artificial Sequence: Synthetic polypeptide
  MOD_RES (13)..(13): Pra
  C-term Amide

SEQ ID NO: 1488 - protein, 34 aa, Artificial Sequence; identical to SEQ ID NO: 1416
  Description of Artificial Sequence: Synthetic polypeptide
  MOD_RES (13)..(13): Pra
  C-term Amide

SEQ ID NO: 1489 - protein, 34 aa, Artificial Sequence; identical to SEQ ID NO: 1417
  Description of Artificial Sequence: Synthetic polypeptide
  MOD_RES (5)..(5): 2-Abu
  MOD_RES (13)..(13): Pra
  C-term Amide

SEQ ID NO: 1490 - protein, 34 aa, Artificial Sequence; identical to SEQ ID NO: 1417
  Description of Artificial Sequence: Synthetic polypeptide
  MOD_RES (5)..(5): Nva
  MOD_RES (13)..(13): Pra
  C-term Amide

SEQ ID NO: 1491 - protein, 34 aa, Artificial Sequence; identical to SEQ ID NO: 1417
  Description of Artificial Sequence: Synthetic polypeptide
  MOD_RES (5)..(5): Nle
  MOD_RES (13)..(13): Pra
  C-term Amide

SEQ ID NO: 1492 - protein, 34 aa, Artificial Sequence; identical to SEQ ID NO: 1420
  Description of Artificial Sequence: Synthetic polypeptide
  MOD_RES (13)..(13): Pra
  C-term Amide

SEQ ID NO: 1493 - protein, 34 aa, Artificial Sequence; identical to SEQ ID NO: 1421
  Description of Artificial Sequence: Synthetic polypeptide
  MOD_RES (13)..(13): Pra
  C-term Amide

SEQ ID NO: 1494 - protein, 34 aa, Artificial Sequence; identical to SEQ ID NO: 1422
  Description of Artificial Sequence: Synthetic polypeptide
  MOD_RES (13)..(13): Pra
  C-term Amide

SEQ ID NO: 1495 - protein, 34 aa, Artificial Sequence; identical to SEQ ID NO: 1423
  Description of Artificial Sequence: Synthetic polypeptide
  MOD_RES (6)..(6): Nle
  MOD_RES (13)..(13): Pra
  C-term Amide

SEQ ID NO: 1496 - protein, 34 aa, Artificial Sequence; identical to SEQ ID NO: 1424
  Description of Artificial Sequence: Synthetic polypeptide
  MOD_RES (6)..(6): Nle
  MOD_RES (13)..(13): Pra
  C-term Amide

SEQ ID NO: 1497 - protein, 34 aa, Artificial Sequence; identical to SEQ ID NO: 1425
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1498 - protein, 34 aa, Artificial Sequence; identical to SEQ ID NO: 1425
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1499 - protein, 34 aa, Artificial Sequence; identical to SEQ ID NO: 1425
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1500 - protein, 34 aa, Artificial Sequence; identical to SEQ ID NO: 1428
  Description of Artificial Sequence: Synthetic polypeptide
  MOD_RES (6)..(6): Nle
  MOD_RES (13)..(13): Pra
  C-term Amide

SEQ ID NO: 1501 - protein, 34 aa, Artificial Sequence; identical to SEQ ID NO: 1429
  Description of Artificial Sequence: Synthetic polypeptide
  MOD_RES (6)..(6): Nle
  MOD_RES (13)..(13): Pra
  C-term Amide

SEQ ID NO: 1502 - protein, 34 aa, Artificial Sequence; identical to SEQ ID NO: 1430
  Description of Artificial Sequence: Synthetic polypeptide
  MOD_RES (6)..(6): Nle
  MOD_RES (13)..(13): Pra
  C-term Amide

SEQ ID NO: 1503 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRLHEWCKYVF

SEQ ID NO: 1504 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRLHEWCKYVF

SEQ ID NO: 1505 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRLHEWCKYVF

SEQ ID NO: 1506 - protein, 34 aa, Artificial Sequence; identical to SEQ ID NO: 1505
  Description of Artificial Sequence: Synthetic polypeptide
  MOD_RES (5)..(5): Nva
  MOD_RES (13)..(13): 2-Abu
  C-term Amide

SEQ ID NO: 1507 - protein, 34 aa, Artificial Sequence; identical to SEQ ID NO: 1505
  Description of Artificial Sequence: Synthetic polypeptide
  MOD_RES (5)..(5): Nle
  MOD_RES (13)..(13): 2-Abu
  C-term Amide

SEQ ID NO: 1508 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRLHEWCKYVF

SEQ ID NO: 1509 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRLHEWCKYVF

SEQ ID NO: 1510 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRLHEWCKYVF

SEQ ID NO: 1511 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRLHEWCKYVF

SEQ ID NO: 1512 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRLHEWCKYVF

SEQ ID NO: 1513 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRLHEWCKYVF

SEQ ID NO: 1514 - protein, 34 aa, Artificial Sequence; identical to SEQ ID NO: 1513
  Description of Artificial Sequence: Synthetic polypeptide
  MOD_RES (5)..(5): Nva
  MOD_RES (13)..(13): 2-Abu
  C-term Amide

SEQ ID NO: 1515 - protein, 34 aa, Artificial Sequence; identical to SEQ ID NO: 1513
  Description of Artificial Sequence: Synthetic polypeptide
  MOD_RES (5)..(5): Nle
  MOD_RES (13)..(13): 2-Abu
  C-term Amide

SEQ ID NO: 1516 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRLHEWCKYVF

SEQ ID NO: 1517 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRLHEWCKYVF

SEQ ID NO: 1518 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRLHEWCKYVF

SEQ ID NO: 1519 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRLHEWCKYVF

SEQ ID NO: 1520 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRLHEWCKYVF

SEQ ID NO: 1521 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRLHEWCKYVF

SEQ ID NO: 1522 - protein, 34 aa, Artificial Sequence; identical to SEQ ID NO: 1521
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1523 - protein, 34 aa, Artificial Sequence; identical to SEQ ID NO: 1521
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1524 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRLHEWCKYVF

SEQ ID NO: 1525 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRLHEWCKYVF

SEQ ID NO: 1526 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRLHEWCKYVF

SEQ ID NO: 1527 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRLHEWCKYVF

SEQ ID NO: 1528 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRLHEWCKYVF

SEQ ID NO: 1529 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRLHEWCKYVF

SEQ ID NO: 1530 - protein, 34 aa, Artificial Sequence; identical to SEQ ID NO: 1529
  Description of Artificial Sequence: Synthetic polypeptide
  MOD_RES (5)..(5): Nva
  MOD_RES (13)..(13): 2-Abu
  C-term Amide

SEQ ID NO: 1531 - protein, 34 aa, Artificial Sequence; identical to SEQ ID NO: 1529
  Description of Artificial Sequence: Synthetic polypeptide
  MOD_RES (5)..(5): Nle
  MOD_RES (13)..(13): 2-Abu
  C-term Amide

SEQ ID NO: 1532 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRLHEWCKYVF

SEQ ID NO: 1533 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRLHEWCKYVF

SEQ ID NO: 1534 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRLHEWCKYVF

SEQ ID NO: 1535 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRLHEWCKYVF

SEQ ID NO: 1536 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRLHEWCKYVF

SEQ ID NO: 1537 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRLHEWCKYVF

SEQ ID NO: 1538 - protein, 34 aa, Artificial Sequence; identical to SEQ ID NO: 1537
  Description of Artificial Sequence: Synthetic polypeptide
  MOD_RES (5)..(5): Nva
  MOD_RES (13)..(13): 2-Abu
  C-term Amide

SEQ ID NO: 1539 - protein, 34 aa, Artificial Sequence; identical to SEQ ID NO: 1537
  Description of Artificial Sequence: Synthetic polypeptide
  MOD_RES (5)..(5): Nle
  MOD_RES (13)..(13): 2-Abu
  C-term Amide

SEQ ID NO: 1540 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRLHEWCKYVF

SEQ ID NO: 1541 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRLHEWCKYVF

SEQ ID NO: 1542 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRLHEWCKYVF

SEQ ID NO: 1543 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRLHEWCKYVF

SEQ ID NO: 1544 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRLHEWCKYVF

SEQ ID NO: 1545 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRLHEWCKYVF

SEQ ID NO: 1546 - protein, 34 aa, Artificial Sequence; identical to SEQ ID NO: 1545
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1547 - protein, 34 aa, Artificial Sequence; identical to SEQ ID NO: 1545
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1548 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRLHEWCKYVF

SEQ ID NO: 1549 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRLHEWCKYVF

SEQ ID NO: 1550 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRLHEWCKYVF

SEQ ID NO: 1551 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRLHEWCKYVF

SEQ ID NO: 1552 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRLHEWCKYVF

SEQ ID NO: 1553 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRLHEWCKYVF

SEQ ID NO: 1554 - protein, 34 aa, Artificial Sequence; identical to SEQ ID NO: 1553
  Description of Artificial Sequence: Synthetic polypeptide
  MOD_RES (5)..(5): Nva
  MOD_RES (13)..(13): 2-Abu
  C-term Amide

SEQ ID NO: 1555 - protein, 34 aa, Artificial Sequence; identical to SEQ ID NO: 1553
  Description of Artificial Sequence: Synthetic polypeptide
  MOD_RES (5)..(5): Nle
  MOD_RES (13)..(13): 2-Abu
  C-term Amide

SEQ ID NO: 1556 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRLHEWCKYVF

SEQ ID NO: 1557 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRLHEWCKYVF

SEQ ID NO: 1558 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRLHEWCKYVF

SEQ ID NO: 1559 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRLHEWCKYVF

SEQ ID NO: 1560 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRLHEWCKYVF

SEQ ID NO: 1561 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRLHEWCKYVF

SEQ ID NO: 1562 - protein, 34 aa, Artificial Sequence; identical to SEQ ID NO: 1561
  Description of Artificial Sequence: Synthetic polypeptide
  MOD_RES (5)..(5): Nva
  MOD_RES (13)..(13): 2-Abu
  C-term Amide

SEQ ID NO: 1563 - protein, 34 aa, Artificial Sequence; identical to SEQ ID NO: 1561
  Description of Artificial Sequence: Synthetic polypeptide
  MOD_RES (5)..(5): Nle
  MOD_RES (13)..(13): 2-Abu
  C-term Amide

SEQ ID NO: 1564 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRLHEWCKYVF

SEQ ID NO: 1565 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRLHEWCKYVF

SEQ ID NO: 1566 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRLHEWCKYVF

SEQ ID NO: 1567 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRLHEWCKYVF

SEQ ID NO: 1568 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRLHEWCKYVF

SEQ ID NO: 1569 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRLHEWCKYVF

SEQ ID NO: 1570 - protein, 34 aa, Artificial Sequence; identical to SEQ ID NO: 1569
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1571 - protein, 34 aa, Artificial Sequence; identical to SEQ ID NO: 1569
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1572 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRLHEWCKYVF

SEQ ID NO: 1573 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRLHEWCKYVF

SEQ ID NO: 1574 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRLHEWCKYVF

SEQ ID NO: 1575 - protein, 34 aa, Artificial Sequence; identical to SEQ ID NO: 1503
  Description of Artificial Sequence: Synthetic polypeptide
  MOD_RES (13)..(13): Pra
  C-term Amide

SEQ ID NO: 1576 - protein, 34 aa, Artificial Sequence; identical to SEQ ID NO: 1504
  Description of Artificial Sequence: Synthetic polypeptide
  MOD_RES (13)..(13): Pra
  C-term Amide

SEQ ID NO: 1577 - protein, 34 aa, Artificial Sequence; identical to SEQ ID NO: 1505
  Description of Artificial Sequence: Synthetic polypeptide
  MOD_RES (5)..(5): 2-Abu
  MOD_RES (13)..(13): Pra
  C-term Amide

SEQ ID NO: 1578 - protein, 34 aa, Artificial Sequence; identical to SEQ ID NO: 1505
  Description of Artificial Sequence: Synthetic polypeptide
  MOD_RES (5)..(5): Nva
  MOD_RES (13)..(13): Pra
  C-term Amide

SEQ ID NO: 1579 - protein, 34 aa, Artificial Sequence; identical to SEQ ID NO: 1505
  Description of Artificial Sequence: Synthetic polypeptide
  MOD_RES (5)..(5): Nle
  MOD_RES (13)..(13): Pra
  C-term Amide

SEQ ID NO: 1580 - protein, 34 aa, Artificial Sequence; identical to SEQ ID NO: 1508
  Description of Artificial Sequence: Synthetic polypeptide
  MOD_RES (13)..(13): Pra
  C-term Amide

SEQ ID NO: 1581 - protein, 34 aa, Artificial Sequence; identical to SEQ ID NO: 1509
  Description of Artificial Sequence: Synthetic polypeptide
  MOD_RES (13)..(13): Pra
  C-term Amide

SEQ ID NO: 1582 - protein, 34 aa, Artificial Sequence; identical to SEQ ID NO: 1510
  Description of Artificial Sequence: Synthetic polypeptide
  MOD_RES (13)..(13): Pra
  C-term Amide

SEQ ID NO: 1583 - protein, 34 aa, Artificial Sequence; identical to SEQ ID NO: 1511
  Description of Artificial Sequence: Synthetic polypeptide
  MOD_RES (13)..(13): Pra
  C-term Amide

SEQ ID NO: 1584 - protein, 34 aa, Artificial Sequence; identical to SEQ ID NO: 1512
  Description of Artificial Sequence: Synthetic polypeptide
  MOD_RES (13)..(13): Pra
  C-term Amide

SEQ ID NO: 1585 - protein, 34 aa, Artificial Sequence; identical to SEQ ID NO: 1513
  Description of Artificial Sequence: Synthetic polypeptide
  MOD_RES (5)..(5): 2-Abu
  MOD_RES (13)..(13): Pra
  C-term Amide

SEQ ID NO: 1586 - protein, 34 aa, Artificial Sequence; identical to SEQ ID NO: 1513
  Description of Artificial Sequence: Synthetic polypeptide
  MOD_RES (5)..(5): Nva
  MOD_RES (13)..(13): Pra
  C-term Amide

SEQ ID NO: 1587 - protein, 34 aa, Artificial Sequence; identical to SEQ ID NO: 1513
  Description of Artificial Sequence: Synthetic polypeptide
  MOD_RES (5)..(5): Nle
  MOD_RES (13)..(13): Pra
  C-term Amide

SEQ ID NO: 1588 - protein, 34 aa, Artificial Sequence; identical to SEQ ID NO: 1516
  Description of Artificial Sequence: Synthetic polypeptide
  MOD_RES (13)..(13): Pra
  C-term Amide

SEQ ID NO: 1589 - protein, 34 aa, Artificial Sequence; identical to SEQ ID NO: 1517
  Description of Artificial Sequence: Synthetic polypeptide
  MOD_RES (13)..(13): Pra
  C-term Amide

SEQ ID NO: 1590 - protein, 34 aa, Artificial Sequence; identical to SEQ ID NO: 1518
  Description of Artificial Sequence: Synthetic polypeptide
  MOD_RES (13)..(13): Pra
  C-term Amide

SEQ ID NO: 1591 - protein, 34 aa, Artificial Sequence; identical to SEQ ID NO: 1519
  Description of Artificial Sequence: Synthetic polypeptide
  MOD_RES (6)..(6): Nle
  MOD_RES (13)..(13): Pra
  C-term Amide

SEQ ID NO: 1592 - protein, 34 aa, Artificial Sequence; identical to SEQ ID NO: 1520
  Description of Artificial Sequence: Synthetic polypeptide
  MOD_RES (6)..(6): Nle
  MOD_RES (13)..(13): Pra
  C-term Amide

SEQ ID NO: 1593 - protein, 34 aa, Artificial Sequence; identical to SEQ ID NO: 1521
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1594 - protein, 34 aa, Artificial Sequence; identical to SEQ ID NO: 1521
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1595 - protein, 34 aa, Artificial Sequence; identical to SEQ ID NO: 1521
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1596 - protein, 34 aa, Artificial Sequence; identical to SEQ ID NO: 1524
  Description of Artificial Sequence: Synthetic polypeptide
  MOD_RES (6)..(6): Nle
  MOD_RES (13)..(13): Pra
  C-term Amide

SEQ ID NO: 1597 - protein, 34 aa, Artificial Sequence; identical to SEQ ID NO: 1525
  Description of Artificial Sequence: Synthetic polypeptide
  MOD_RES (6)..(6): Nle
  MOD_RES (13)..(13): Pra
  C-term Amide

SEQ ID NO: 1598 - protein, 34 aa, Artificial Sequence; identical to SEQ ID NO: 1526
  Description of Artificial Sequence: Synthetic polypeptide
  MOD_RES (6)..(6): Nle
  MOD_RES (13)..(13): Pra
  C-term Amide

SEQ ID NO: 1599 - protein, 34 aa, Artificial Sequence; identical to SEQ ID NO: 1527
  Description of Artificial Sequence: Synthetic polypeptide
  MOD_RES (13)..(13): Pra
  C-term Amide

SEQ ID NO: 1600 - protein, 34 aa, Artificial Sequence; identical to SEQ ID NO: 1528
  Description of Artificial Sequence: Synthetic polypeptide
  MOD_RES (13)..(13): Pra
  C-term Amide

SEQ ID NO: 1601 - protein, 34 aa, Artificial Sequence; identical to SEQ ID NO: 1529
  Description of Artificial Sequence: Synthetic polypeptide
  MOD_RES (5)..(5): 2-Abu
  MOD_RES (13)..(13): Pra
  C-term Amide

SEQ ID NO: 1602 - protein, 34 aa, Artificial Sequence; identical to SEQ ID NO: 1529
  Description of Artificial Sequence: Synthetic polypeptide
  MOD_RES (5)..(5): Nva
  MOD_RES (13)..(13): Pra
  C-term Amide

SEQ ID NO: 1603 - protein, 34 aa, Artificial Sequence; identical to SEQ ID NO: 1529
  Description of Artificial Sequence: Synthetic polypeptide
  MOD_RES (5)..(5): Nle
  MOD_RES (13)..(13): Pra
  C-term Amide

SEQ ID NO: 1604 - protein, 34 aa, Artificial Sequence; identical to SEQ ID NO: 1532
  Description of Artificial Sequence: Synthetic polypeptide
  MOD_RES (13)..(13): Pra
  C-term Amide

SEQ ID NO: 1605 - protein, 34 aa, Artificial Sequence; identical to SEQ ID NO: 1533
  Description of Artificial Sequence: Synthetic polypeptide
  MOD_RES (13)..(13): Pra
  C-term Amide

SEQ ID NO: 1606 - protein, 34 aa, Artificial Sequence; identical to SEQ ID NO: 1534
  Description of Artificial Sequence: Synthetic polypeptide
  MOD_RES (13)..(13): Pra
  C-term Amide

SEQ ID NO: 1607 - protein, 34 aa, Artificial Sequence; identical to SEQ ID NO: 1535
  Description of Artificial Sequence: Synthetic polypeptide
  MOD_RES (13)..(13): Pra
  C-term Amide

SEQ ID NO: 1608 - protein, 34 aa, Artificial Sequence; identical to SEQ ID NO: 1536
  Description of Artificial Sequence: Synthetic polypeptide
  MOD_RES (13)..(13): Pra
  C-term Amide

SEQ ID NO: 1609 - protein, 34 aa, Artificial Sequence; identical to SEQ ID NO: 1537
  Description of Artificial Sequence: Synthetic polypeptide
  MOD_RES (5)..(5): 2-Abu
  MOD_RES (13)..(13): Pra
  C-term Amide

SEQ ID NO: 1610 - protein, 34 aa, Artificial Sequence; identical to SEQ ID NO: 1537
  Description of Artificial Sequence: Synthetic polypeptide
  MOD_RES (5)..(5): Nva
  MOD_RES (13)..(13): Pra
  C-term Amide

SEQ ID NO: 1611 - protein, 34 aa, Artificial Sequence; identical to SEQ ID NO: 1537
  Description of Artificial Sequence: Synthetic polypeptide
  MOD_RES (5)..(5): Nle
  MOD_RES (13)..(13): Pra
  C-term Amide

SEQ ID NO: 1612 - protein, 34 aa, Artificial Sequence; identical to SEQ ID NO: 1540
  Description of Artificial Sequence: Synthetic polypeptide
  MOD_RES (13)..(13): Pra
  C-term Amide

SEQ ID NO: 1613 - protein, 34 aa, Artificial Sequence; identical to SEQ ID NO: 1541
  Description of Artificial Sequence: Synthetic polypeptide
  MOD_RES (13)..(13): Pra
  C-term Amide

SEQ ID NO: 1614 - protein, 34 aa, Artificial Sequence; identical to SEQ ID NO: 1542
  Description of Artificial Sequence: Synthetic polypeptide
  MOD_RES (13)..(13): Pra
  C-term Amide

SEQ ID NO: 1615 - protein, 34 aa, Artificial Sequence; identical to SEQ ID NO: 1543
  Description of Artificial Sequence: Synthetic polypeptide
  MOD_RES (6)..(6): Nle
  MOD_RES (13)..(13): Pra
  C-term Amide

SEQ ID NO: 1616 - protein, 34 aa, Artificial Sequence; identical to SEQ ID NO: 1544
  Description of Artificial Sequence: Synthetic polypeptide
  MOD_RES (6)..(6): Nle
  MOD_RES (13)..(13): Pra
  C-term Amide

SEQ ID NO: 1617 - protein, 34 aa, Artificial Sequence; identical to SEQ ID NO: 1545
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1618 - protein, 34 aa, Artificial Sequence; identical to SEQ ID NO: 1545
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1619 - protein, 34 aa, Artificial Sequence; identical to SEQ ID NO: 1545
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1620 - protein, 34 aa, Artificial Sequence; identical to SEQ ID NO: 1548
  Description of Artificial Sequence: Synthetic polypeptide
  MOD_RES (6)..(6): Nle
  MOD_RES (13)..(13): Pra
  C-term Amide

SEQ ID NO: 1621 - protein, 34 aa, Artificial Sequence; identical to SEQ ID NO: 1549
  Description of Artificial Sequence: Synthetic polypeptide
  MOD_RES (6)..(6): Nle
  MOD_RES (13)..(13): Pra
  C-term Amide

SEQ ID NO: 1622 - protein, 34 aa, Artificial Sequence; identical to SEQ ID NO: 1550
  Description of Artificial Sequence: Synthetic polypeptide
  MOD_RES (6)..(6): Nle
  MOD_RES (13)..(13): Pra
  C-term Amide

SEQ ID NO: 1623 - protein, 34 aa, Artificial Sequence; identical to SEQ ID NO: 1551
  Description of Artificial Sequence: Synthetic polypeptide
  MOD_RES (13)..(13): Pra
  C-term Amide

SEQ ID NO: 1624 - protein, 34 aa, Artificial Sequence; identical to SEQ ID NO: 1552
  Description of Artificial Sequence: Synthetic polypeptide
  MOD_RES (13)..(13): Pra
  C-term Amide

SEQ ID NO: 1625 - protein, 34 aa, Artificial Sequence; identical to SEQ ID NO: 1553
  Description of Artificial Sequence: Synthetic polypeptide
  MOD_RES (5)..(5): 2-Abu
  MOD_RES (13)..(13): Pra
  C-term Amide

SEQ ID NO: 1626 - protein, 34 aa, Artificial Sequence; identical to SEQ ID NO: 1553
  Description of Artificial Sequence: Synthetic polypeptide
  MOD_RES (5)..(5): Nva
  MOD_RES (13)..(13): Pra
  C-term Amide

SEQ ID NO: 1627 - protein, 34 aa, Artificial Sequence; identical to SEQ ID NO: 1553
  Description of Artificial Sequence: Synthetic polypeptide
  MOD_RES (5)..(5): Nle
  MOD_RES (13)..(13): Pra
  C-term Amide

SEQ ID NO: 1628 - protein, 34 aa, Artificial Sequence; identical to SEQ ID NO: 1556
  Description of Artificial Sequence: Synthetic polypeptide
  MOD_RES (13)..(13): Pra
  C-term Amide

SEQ ID NO: 1629 - protein, 34 aa, Artificial Sequence; identical to SEQ ID NO: 1557
  Description of Artificial Sequence: Synthetic polypeptide
  MOD_RES (13)..(13): Pra
  C-term Amide

SEQ ID NO: 1630 - protein, 34 aa, Artificial Sequence; identical to SEQ ID NO: 1558
  Description of Artificial Sequence: Synthetic polypeptide
  MOD_RES (13)..(13): Pra
  C-term Amide

SEQ ID NO: 1631 - protein, 34 aa, Artificial Sequence; identical to SEQ ID NO: 1559
  Description of Artificial Sequence: Synthetic polypeptide
  MOD_RES (13)..(13): Pra
  C-term Amide

SEQ ID NO: 1632 - protein, 34 aa, Artificial Sequence; identical to SEQ ID NO: 1560
  Description of Artificial Sequence: Synthetic polypeptide
  MOD_RES (13)..(13): Pra
  C-term Amide

SEQ ID NO: 1633 - protein, 34 aa, Artificial Sequence; identical to SEQ ID NO: 1561
  Description of Artificial Sequence: Synthetic polypeptide
  MOD_RES (5)..(5): 2-Abu
  MOD_RES (13)..(13): Pra
  C-term Amide

SEQ ID NO: 1634 - protein, 34 aa, Artificial Sequence; identical to SEQ ID NO: 1561
  Description of Artificial Sequence: Synthetic polypeptide
  MOD_RES (5)..(5): Nva
  MOD_RES (13)..(13): Pra
  C-term Amide

SEQ ID NO: 1635 - protein, 34 aa, Artificial Sequence; identical to SEQ ID NO: 1561
  Description of Artificial Sequence: Synthetic polypeptide
  MOD_RES (5)..(5): Nle
  MOD_RES (13)..(13): Pra
  C-term Amide

SEQ ID NO: 1636 - protein, 34 aa, Artificial Sequence; identical to SEQ ID NO: 1564
  Description of Artificial Sequence: Synthetic polypeptide
  MOD_RES (13)..(13): Pra
  C-term Amide

SEQ ID NO: 1637 - protein, 34 aa, Artificial Sequence; identical to SEQ ID NO: 1565
  Description of Artificial Sequence: Synthetic polypeptide
  MOD_RES (13)..(13): Pra
  C-term Amide

SEQ ID NO: 1638 - protein, 34 aa, Artificial Sequence; identical to SEQ ID NO: 1566
  Description of Artificial Sequence: Synthetic polypeptide
  MOD_RES (13)..(13): Pra
  C-term Amide

SEQ ID NO: 1639 - protein, 34 aa, Artificial Sequence; identical to SEQ ID NO: 1567
  Description of Artificial Sequence: Synthetic polypeptide
  MOD_RES (6)..(6): Nle
  MOD_RES (13)..(13): Pra
  C-term Amide

SEQ ID NO: 1640 - protein, 34 aa, Artificial Sequence; identical to SEQ ID NO: 1568
  Description of Artificial Sequence: Synthetic polypeptide
  MOD_RES (6)..(6): Nle
  MOD_RES (13)..(13): Pra
  C-term Amide

SEQ ID NO: 1641 - protein, 34 aa, Artificial Sequence; identical to SEQ ID NO: 1569
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1642 - protein, 34 aa, Artificial Sequence; identical to SEQ ID NO: 1569
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1643 - protein, 34 aa, Artificial Sequence; identical to SEQ ID NO: 1569
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1644 - protein, 34 aa, Artificial Sequence; identical to SEQ ID NO: 1572
  Description of Artificial Sequence: Synthetic polypeptide
  MOD_RES (6)..(6): Nle
  MOD_RES (13)..(13): Pra
  C-term Amide

SEQ ID NO: 1645 - protein, 34 aa, Artificial Sequence; identical to SEQ ID NO: 1573
  Description of Artificial Sequence: Synthetic polypeptide
  MOD_RES (6)..(6): Nle
  MOD_RES (13)..(13): Pra
  C-term Amide

SEQ ID NO: 1646 - protein, 34 aa, Artificial Sequence; identical to SEQ ID NO: 1574
  Description of Artificial Sequence: Synthetic polypeptide
  MOD_RES (6)..(6): Nle
  MOD_RES (13)..(13): Pra
  C-term Amide

SEQ ID NO: 1647 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRTHDWCKYVF

SEQ ID NO: 1648 - protein, 34 aa, Artificial Sequence; identical to SEQ ID NO: 1647
  Description of Artificial Sequence: Synthetic polypeptide
  MOD_RES (13)..(13): Pra
  C-term Amide

SEQ ID NO: 1649 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRLHDWCKYVF

SEQ ID NO: 1650 - protein, 34 aa, Artificial Sequence; identical to SEQ ID NO: 1649
  Description of Artificial Sequence: Synthetic polypeptide
  MOD_RES (13)..(13): Pra
  C-term Amide

SEQ ID NO: 1651 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRTHDWCKYVF

SEQ ID NO: 1652 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRTHDWCKYVF

SEQ ID NO: 1653 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRTHDWCKYVF

SEQ ID NO: 1654 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRTHDWCKYVF

SEQ ID NO: 1655 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRTHDWCKYVF

SEQ ID NO: 1656 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRTHDWCKYVF

SEQ ID NO: 1657 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRTHDWCKYVF

SEQ ID NO: 1658 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRTHDWCKYVF

SEQ ID NO: 1659 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRTHDWCKYVF

SEQ ID NO: 1660 - protein, 34 aa, Artificial Sequence; identical to SEQ ID NO: 1659
  Description of Artificial Sequence: Synthetic polypeptide
  MOD_RES (5)..(5): Nva
  MOD_RES (13)..(13): 2-Abu
  C-term Amide

SEQ ID NO: 1661 - protein, 34 aa, Artificial Sequence; identical to SEQ ID NO: 1659
  Description of Artificial Sequence: Synthetic polypeptide
  MOD_RES (5)..(5): Nle
  MOD_RES (13)..(13): 2-Abu
  C-term Amide

SEQ ID NO: 1662 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRTHDWCKYVF

SEQ ID NO: 1663 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRTHDWCKYVF

SEQ ID NO: 1664 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRTHDWCKYVF

SEQ ID NO: 1665 - protein, 34 aa, Artificial Sequence; identical to SEQ ID NO: 1651
  Description of Artificial Sequence: Synthetic polypeptide
  MOD_RES (13)..(13): Pra
  C-term Amide

SEQ ID NO: 1666 - protein, 34 aa, Artificial Sequence; identical to SEQ ID NO: 1652
  Description of Artificial Sequence: Synthetic polypeptide
  MOD_RES (13)..(13): Pra
  C-term Amide

SEQ ID NO: 1667 - protein, 34 aa, Artificial Sequence; identical to SEQ ID NO: 1653
  Description of Artificial Sequence: Synthetic polypeptide
  MOD_RES (13)..(13): Pra
  C-term Amide

SEQ ID NO: 1668 - protein, 34 aa, Artificial Sequence; identical to SEQ ID NO: 1654
  Description of Artificial Sequence: Synthetic polypeptide
  MOD_RES (13)..(13): Pra
  C-term Amide

SEQ ID NO: 1669 - protein, 34 aa, Artificial Sequence; identical to SEQ ID NO: 1655
  Description of Artificial Sequence: Synthetic polypeptide
  MOD_RES (13)..(13): Pra
  C-term Amide

SEQ ID NO: 1670 - protein, 34 aa, Artificial Sequence; identical to SEQ ID NO: 1656
  Description of Artificial Sequence: Synthetic polypeptide
  MOD_RES (6)..(6): Nle
  MOD_RES (13)..(13): Pra
  C-term Amide

SEQ ID NO: 1671 - protein, 34 aa, Artificial Sequence; identical to SEQ ID NO: 1657
  Description of Artificial Sequence: Synthetic polypeptide
  MOD_RES (13)..(13): Pra
  C-term Amide

SEQ ID NO: 1672 - protein, 34 aa, Artificial Sequence; identical to SEQ ID NO: 1658
  Description of Artificial Sequence: Synthetic polypeptide
  MOD_RES (13)..(13): Pra
  C-term Amide

SEQ ID NO: 1673 - protein, 34 aa, Artificial Sequence; identical to SEQ ID NO: 1659
  Description of Artificial Sequence: Synthetic polypeptide
  MOD_RES (5)..(5): 2-Abu
  MOD_RES (13)..(13): Pra
  C-term Amide

SEQ ID NO: 1674 - protein, 34 aa, Artificial Sequence; identical to SEQ ID NO: 1659
  Description of Artificial Sequence: Synthetic polypeptide
  MOD_RES (5)..(5): Nva
  MOD_RES (13)..(13): Pra
  C-term Amide

SEQ ID NO: 1675 - protein, 34 aa, Artificial Sequence; identical to SEQ ID NO: 1659
  Description of Artificial Sequence: Synthetic polypeptide
  MOD_RES (5)..(5): Nle
  MOD_RES (13)..(13): Pra
  C-term Amide

SEQ ID NO: 1676 - protein, 34 aa, Artificial Sequence; identical to SEQ ID NO: 1662
  Description of Artificial Sequence: Synthetic polypeptide
  MOD_RES (13)..(13): Pra
  C-term Amide

SEQ ID NO: 1677 - protein, 34 aa, Artificial Sequence; identical to SEQ ID NO: 1663
  Description of Artificial Sequence: Synthetic polypeptide
  MOD_RES (13)..(13): Pra
  C-term Amide

SEQ ID NO: 1678 - protein, 34 aa, Artificial Sequence; identical to SEQ ID NO: 1664
  Description of Artificial Sequence: Synthetic polypeptide
  MOD_RES (13)..(13): Pra
  C-term Amide

SEQ ID NO: 1679 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRLHDWCKYVF

SEQ ID NO: 1680 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRLHDWCKYVF

SEQ ID NO: 1681 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRLHDWCKYVF

SEQ ID NO: 1682 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRLHDWCKYVF

SEQ ID NO: 1683 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRLHDWCKYVF

SEQ ID NO: 1684 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRLHDWCKYVF

SEQ ID NO: 1685 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRLHDWCKYVF

SEQ ID NO: 1686 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRLHDWCKYVF

SEQ ID NO: 1687 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRLHDWCKYVF

SEQ ID NO: 1688 - protein, 34 aa, Artificial Sequence; identical to SEQ ID NO: 1687
  Description of Artificial Sequence: Synthetic polypeptide
  MOD_RES (5)..(5): Nva
  MOD_RES (13)..(13): 2-Abu
  C-term Amide

SEQ ID NO: 1689 - protein, 34 aa, Artificial Sequence; identical to SEQ ID NO: 1687
  Description of Artificial Sequence: Synthetic polypeptide
  MOD_RES (5)..(5): Nle
  MOD_RES (13)..(13): 2-Abu
  C-term Amide

SEQ ID NO: 1690 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRLHDWCKYVF

SEQ ID NO: 1691 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRLHDWCKYVF

SEQ ID NO: 1692 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRLHDWCKYVF

SEQ ID NO: 1693 - protein, 34 aa, Artificial Sequence; identical to SEQ ID NO: 1679
  Description of Artificial Sequence: Synthetic polypeptide
  MOD_RES (13)..(13): Pra
  C-term Amide

SEQ ID NO: 1694 - protein, 34 aa, Artificial Sequence; identical to SEQ ID NO: 1680
  Description of Artificial Sequence: Synthetic polypeptide
  MOD_RES (13)..(13): Pra
  C-term Amide

SEQ ID NO: 1695 - protein, 34 aa, Artificial Sequence; identical to SEQ ID NO: 1681
  Description of Artificial Sequence: Synthetic polypeptide
  MOD_RES (13)..(13): Pra
  C-term Amide

SEQ ID NO: 1696 - protein, 34 aa, Artificial Sequence; identical to SEQ ID NO: 1682
  Description of Artificial Sequence: Synthetic polypeptide
  MOD_RES (13)..(13): Pra
  C-term Amide

SEQ ID NO: 1697 - protein, 34 aa, Artificial Sequence; identical to SEQ ID NO: 1683
  Description of Artificial Sequence: Synthetic polypeptide
  MOD_RES (13)..(13): Pra
  C-term Amide

SEQ ID NO: 1698 - protein, 34 aa, Artificial Sequence; identical to SEQ ID NO: 1684
  Description of Artificial Sequence: Synthetic polypeptide
  MOD_RES (6)..(6): Nle
  MOD_RES (13)..(13): Pra
  C-term Amide

SEQ ID NO: 1699 - protein, 34 aa, Artificial Sequence; identical to SEQ ID NO: 1685
  Description of Artificial Sequence: Synthetic polypeptide
  MOD_RES (13)..(13): Pra
  C-term Amide

SEQ ID NO: 1700 - protein, 34 aa, Artificial Sequence; identical to SEQ ID NO: 1686
  Description of Artificial Sequence: Synthetic polypeptide
  MOD_RES (13)..(13): Pra
  C-term Amide

SEQ ID NO: 1701 - protein, 34 aa, Artificial Sequence; identical to SEQ ID NO: 1687
  Description of Artificial Sequence: Synthetic polypeptide
  MOD_RES (5)..(5): 2-Abu
  MOD_RES (13)..(13): Pra
  C-term Amide

SEQ ID NO: 1702 - protein, 34 aa, Artificial Sequence; identical to SEQ ID NO: 1687
  Description of Artificial Sequence: Synthetic polypeptide
  MOD_RES (5)..(5): Nva
  MOD_RES (13)..(13): Pra
  C-term Amide

SEQ ID NO: 1703 - protein, 34 aa, Artificial Sequence; identical to SEQ ID NO: 1687
  Description of Artificial Sequence: Synthetic polypeptide
  MOD_RES (5)..(5): Nle
  MOD_RES (13)..(13): Pra
  C-term Amide

SEQ ID NO: 1704 - protein, 34 aa, Artificial Sequence; identical to SEQ ID NO: 1690
  Description of Artificial Sequence: Synthetic polypeptide
  MOD_RES (13)..(13): Pra
  C-term Amide

SEQ ID NO: 1705 - protein, 34 aa, Artificial Sequence; identical to SEQ ID NO: 1691
  Description of Artificial Sequence: Synthetic polypeptide
  MOD_RES (13)..(13): Pra
  C-term Amide

SEQ ID NO: 1706 - protein, 34 aa, Artificial Sequence; identical to SEQ ID NO: 1692
  Description of Artificial Sequence: Synthetic polypeptide
  MOD_RES (13)..(13): Pra
  C-term Amide

SEQ ID NO: 1707 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRTHDWCKYVF

SEQ ID NO: 1708 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRTHDWCKYVF

SEQ ID NO: 1709 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRTHDWCKYVF

SEQ ID NO: 1710 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRTHDWCKYVF

SEQ ID NO: 1711 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRTHDWCKYVF

SEQ ID NO: 1712 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRTHDWCKYVF

SEQ ID NO: 1713 - protein, 34 aa, Artificial Sequence; identical to SEQ ID NO: 1712
  Description of Artificial Sequence: Synthetic polypeptide
  MOD_RES (5)..(5): Nva
  MOD_RES (13)..(13): 2-Abu
  C-term Amide

SEQ ID NO: 1714 - protein, 34 aa, Artificial Sequence; identical to SEQ ID NO: 1712
  Description of Artificial Sequence: Synthetic polypeptide
  MOD_RES (5)..(5): Nle
  MOD_RES (13)..(13): 2-Abu
  C-term Amide

SEQ ID NO: 1715 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRTHDWCKYVF

SEQ ID NO: 1716 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRTHDWCKYVF

SEQ ID NO: 1717 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRTHDWCKYVF

SEQ ID NO: 1718 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRTHDWCKYVF

SEQ ID NO: 1719 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRTHDWCKYVF

SEQ ID NO: 1720 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRTHDWCKYVF

SEQ ID NO: 1721 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRTHDWCKYVF

SEQ ID NO: 1722 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRTHDWCKYVF

SEQ ID NO: 1723 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRTHDWCKYVF

SEQ ID NO: 1724 - protein, 34 aa, Artificial Sequence; identical to SEQ ID NO: 1723
  Description of Artificial Sequence: Synthetic polypeptide
  MOD_RES (5)..(5): Nva
  MOD_RES (13)..(13): 2-Abu
  C-term Amide

SEQ ID NO: 1725 - protein, 34 aa, Artificial Sequence; identical to SEQ ID NO: 1723
  Description of Artificial Sequence: Synthetic polypeptide
  MOD_RES (5)..(5): Nle
  MOD_RES (13)..(13): 2-Abu
  C-term Amide

SEQ ID NO: 1726 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRTHDWCKYVF

SEQ ID NO: 1727 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRTHDWCKYVF

SEQ ID NO: 1728 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRTHDWCKYVF

SEQ ID NO: 1729 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRTHDWCKYVF

SEQ ID NO: 1730 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRTHDWCKYVF

SEQ ID NO: 1731 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRTHDWCKYVF

SEQ ID NO: 1732 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRTHDWCKYVF

SEQ ID NO: 1733 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRTHDWCKYVF

SEQ ID NO: 1734 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRTHDWCKYVF

SEQ ID NO: 1735 - protein, 34 aa, Artificial Sequence; identical to SEQ ID NO: 1734
  Description of Artificial Sequence: Synthetic polypeptide
  MOD_RES (5)..(5): Nva
  MOD_RES (13)..(13): 2-Abu
  C-term Amide

SEQ ID NO: 1736 - protein, 34 aa, Artificial Sequence; identical to SEQ ID NO: 1734
  Description of Artificial Sequence: Synthetic polypeptide
  MOD_RES (5)..(5): Nle
  MOD_RES (13)..(13): 2-Abu
  C-term Amide

SEQ ID NO: 1737 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRTHDWCKYVF

SEQ ID NO: 1738 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRTHDWCKYVF

SEQ ID NO: 1739 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRTHDWCKYVF

SEQ ID NO: 1740 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRTHDWCKYVF

SEQ ID NO: 1741 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRTHDWCKYVF

SEQ ID NO: 1742 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRTHDWCKYVF

SEQ ID NO: 1743 - protein, 34 aa, Artificial Sequence; identical to SEQ ID NO: 1742
  Description of Artificial Sequence: Synthetic polypeptide
  MOD_RES (5)..(5): Nva
  MOD_RES (13)..(13): 2-Abu
  C-term Amide

SEQ ID NO: 1744 - protein, 34 aa, Artificial Sequence; identical to SEQ ID NO: 1742
  Description of Artificial Sequence: Synthetic polypeptide
  MOD_RES (5)..(5): Nle
  MOD_RES (13)..(13): 2-Abu
  C-term Amide

SEQ ID NO: 1745 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRTHDWCKYVF

SEQ ID NO: 1746 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRTHDWCKYVF

SEQ ID NO: 1747 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRTHDWCKYVF

SEQ ID NO: 1748 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRTHDWCKYVF

SEQ ID NO: 1749 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRTHDWCKYVF

SEQ ID NO: 1750 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSRTHDWCKYVF

SEQ ID NO: 1751 - protein, 34 aa, Artificial Sequence; identical to SEQ ID NO: 1750
  Description of Artificial Sequence: Synthetic polypeptide
  MOD_RES (5)..(5): Nva
  MOD_RES (13)..(13): 2-Abu
  C-term Amide

SEQ ID NO: 1752 - protein, 34 aa, Artificial Sequence; identical to SEQ ID NO: 1750
  Description of Artificial Sequence: Synthetic polypeptide
  MOD_RES (5)..(5): Nle
  MOD_RES (13)..(13): 2-Abu
  C-term Amide

SEQ ID NO: 1753 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRTHDWCKYVF

SEQ ID NO: 1754 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRTHDWCKYVF

SEQ ID NO: 1755 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRTHDWCKYVF

SEQ ID NO: 1756 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRTHDWCKYVF

SEQ ID NO: 1757 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRTHDWCKYVF

SEQ ID NO: 1758 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRTHDWCKYVF

SEQ ID NO: 1759 - protein, 34 aa, Artificial Sequence; identical to SEQ ID NO: 1758
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1760 - protein, 34 aa, Artificial Sequence; identical to SEQ ID NO: 1758
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1761 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRTHDWCKYVF

SEQ ID NO: 1762 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRTHDWCKYVF

SEQ ID NO: 1763 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRTHDWCKYVF

SEQ ID NO: 1764 - protein, 34 aa, Artificial Sequence; identical to SEQ ID NO: 1707
  Description of Artificial Sequence: Synthetic polypeptide
  MOD_RES (13)..(13): Pra
  C-term Amide

SEQ ID NO: 1765 - protein, 34 aa, Artificial Sequence; identical to SEQ ID NO: 1708
  Description of Artificial Sequence: Synthetic polypeptide
  MOD_RES (13)..(13): Pra
  C-term Amide

SEQ ID NO: 1766 - protein, 34 aa, Artificial Sequence; identical to SEQ ID NO: 1709
  Description of Artificial Sequence: Synthetic polypeptide
  MOD_RES (6)..(6): Nle
  MOD_RES (13)..(13): Pra
  C-term Amide

SEQ ID NO: 1767 - protein, 34 aa, Artificial Sequence; identical to SEQ ID NO: 1710
  Description of Artificial Sequence: Synthetic polypeptide
  MOD_RES (13)..(13): Pra
  C-term Amide

SEQ ID NO: 1768 - protein, 34 aa, Artificial Sequence; identical to SEQ ID NO: 1711
  Description of Artificial Sequence: Synthetic polypeptide
  MOD_RES (13)..(13): Pra
  C-term Amide

SEQ ID NO: 1769 - protein, 34 aa, Artificial Sequence; identical to SEQ ID NO: 1712
  Description of Artificial Sequence: Synthetic polypeptide
  MOD_RES (5)..(5): 2-Abu
  MOD_RES (13)..(13): Pra
  C-term Amide

SEQ ID NO: 1770 - protein, 34 aa, Artificial Sequence; identical to SEQ ID NO: 1712
  Description of Artificial Sequence: Synthetic polypeptide
  MOD_RES (5)..(5): Nva
  MOD_RES (13)..(13): Pra
  C-term Amide

SEQ ID NO: 1771 - protein, 34 aa, Artificial Sequence; identical to SEQ ID NO: 1712
  Description of Artificial Sequence: Synthetic polypeptide
  MOD_RES (5)..(5): Nle
  MOD_RES (13)..(13): Pra
  C-term Amide

SEQ ID NO: 1772 - protein, 34 aa, Artificial Sequence; identical to SEQ ID NO: 1715
  Description of Artificial Sequence: Synthetic polypeptide
  MOD_RES (13)..(13): Pra
  C-term Amide

SEQ ID NO: 1773 - protein, 34 aa, Artificial Sequence; identical to SEQ ID NO: 1716
  Description of Artificial Sequence: Synthetic polypeptide
  MOD_RES (13)..(13): Pra
  C-term Amide

SEQ ID NO: 1774 - protein, 34 aa, Artificial Sequence; identical to SEQ ID NO: 1717
  Description of Artificial Sequence: Synthetic polypeptide
  MOD_RES (13)..(13): Pra
  C-term Amide

SEQ ID NO: 1775 - protein, 34 aa, Artificial Sequence; identical to SEQ ID NO: 1718
  Description of Artificial Sequence: Synthetic polypeptide
  MOD_RES (13)..(13): Pra
  C-term Amide

SEQ ID NO: 1776 - protein, 34 aa, Artificial Sequence; identical to SEQ ID NO: 1719
  Description of Artificial Sequence: Synthetic polypeptide
  MOD_RES (13)..(13): Pra
  C-term Amide

SEQ ID NO: 1777 - protein, 34 aa, Artificial Sequence; identical to SEQ ID NO: 1720
  Description of Artificial Sequence: Synthetic polypeptide
  MOD_RES (6)..(6): Nle
  MOD_RES (13)..(13): Pra
  C-term Amide

SEQ ID NO: 1778 - protein, 34 aa, Artificial Sequence; identical to SEQ ID NO: 1721
  Description of Artificial Sequence: Synthetic polypeptide
  MOD_RES (13)..(13): Pra
  C-term Amide

SEQ ID NO: 1779 - protein, 34 aa, Artificial Sequence; identical to SEQ ID NO: 1722
  Description of Artificial Sequence: Synthetic polypeptide
  MOD_RES (13)..(13): Pra
  C-term Amide

SEQ ID NO: 1780 - protein, 34 aa, Artificial Sequence; identical to SEQ ID NO: 1723
  Description of Artificial Sequence: Synthetic polypeptide
  MOD_RES (5)..(5): 2-Abu
  MOD_RES (13)..(13): Pra
  C-term Amide

SEQ ID NO: 1781 - protein, 34 aa, Artificial Sequence; identical to SEQ ID NO: 1723
  Description of Artificial Sequence: Synthetic polypeptide
  MOD_RES (5)..(5): Nva
  MOD_RES (13)..(13): Pra
  C-term Amide

SEQ ID NO: 1782 - protein, 34 aa, Artificial Sequence; identical to SEQ ID NO: 1723
  Description of Artificial Sequence: Synthetic polypeptide
  MOD_RES (5)..(5): Nle
  MOD_RES (13)..(13): Pra
  C-term Amide

SEQ ID NO: 1783 - protein, 34 aa, Artificial Sequence; identical to SEQ ID NO: 1726
  Description of Artificial Sequence: Synthetic polypeptide
  MOD_RES (13)..(13): Pra
  C-term Amide

SEQ ID NO: 1784 - protein, 34 aa, Artificial Sequence; identical to SEQ ID NO: 1727
  Description of Artificial Sequence: Synthetic polypeptide
  MOD_RES (13)..(13): Pra
  C-term Amide

SEQ ID NO: 1785 - protein, 34 aa, Artificial Sequence; identical to SEQ ID NO: 1728
  Description of Artificial Sequence: Synthetic polypeptide
  MOD_RES (13)..(13): Pra
  C-term Amide

SEQ ID NO: 1786 - protein, 34 aa, Artificial Sequence; identical to SEQ ID NO: 1729
  Description of Artificial Sequence: Synthetic polypeptide
  MOD_RES (13)..(13): Pra
  C-term Amide

SEQ ID NO: 1787 - protein, 34 aa, Artificial Sequence; identical to SEQ ID NO: 1730
  Description of Artificial Sequence: Synthetic polypeptide
  MOD_RES (13)..(13): Pra
  C-term Amide

SEQ ID NO: 1788 - protein, 34 aa, Artificial Sequence; identical to SEQ ID NO: 1731
  Description of Artificial Sequence: Synthetic polypeptide
  MOD_RES (6)..(6): Nle
  MOD_RES (13)..(13): Pra
  C-term Amide

SEQ ID NO: 1789 - protein, 34 aa, Artificial Sequence; identical to SEQ ID NO: 1732
  Description of Artificial Sequence: Synthetic polypeptide
  MOD_RES (13)..(13): Pra
  C-term Amide

SEQ ID NO: 1790 - protein, 34 aa, Artificial Sequence; identical to SEQ ID NO: 1733
  Description of Artificial Sequence: Synthetic polypeptide
  MOD_RES (13)..(13): Pra
  C-term Amide

SEQ ID NO: 1791 - protein, 34 aa, Artificial Sequence; identical to SEQ ID NO: 1734
  Description of Artificial Sequence: Synthetic polypeptide
  MOD_RES (5)..(5): 2-Abu
  MOD_RES (13)..(13): Pra
  C-term Amide

SEQ ID NO: 1792 - protein, 34 aa, Artificial Sequence; identical to SEQ ID NO: 1734
  Description of Artificial Sequence: Synthetic polypeptide
  MOD_RES (5)..(5): Nva
  MOD_RES (13)..(13): Pra
  C-term Amide

SEQ ID NO: 1793 - protein, 34 aa, Artificial Sequence; identical to SEQ ID NO: 1734
  Description of Artificial Sequence: Synthetic polypeptide
  MOD_RES (5)..(5): Nle
  MOD_RES (13)..(13): Pra
  C-term Amide

SEQ ID NO: 1794 - protein, 34 aa, Artificial Sequence; identical to SEQ ID NO: 1737
  Description of Artificial Sequence: Synthetic polypeptide
  MOD_RES (13)..(13): Pra
  C-term Amide

SEQ ID NO: 1795 - protein, 34 aa, Artificial Sequence; identical to SEQ ID NO: 1738
  Description of Artificial Sequence: Synthetic polypeptide
  MOD_RES (13)..(13): Pra
  C-term Amide

SEQ ID NO: 1796 - protein, 34 aa, Artificial Sequence; identical to SEQ ID NO: 1739
  Description of Artificial Sequence: Synthetic polypeptide
  MOD_RES (13)..(13): Pra
  C-term Amide

SEQ ID NO: 1797 - protein, 34 aa, Artificial Sequence; identical to SEQ ID NO: 1740
  Description of Artificial Sequence: Synthetic polypeptide
  MOD_RES (13)..(13): Pra
  C-term Amide

SEQ ID NO: 1798 - protein, 34 aa, Artificial Sequence; identical to SEQ ID NO: 1741
  Description of Artificial Sequence: Synthetic polypeptide
  MOD_RES (13)..(13): Pra
  C-term Amide

SEQ ID NO: 1799 - protein, 34 aa, Artificial Sequence; identical to SEQ ID NO: 1742
  Description of Artificial Sequence: Synthetic polypeptide
  MOD_RES (5)..(5): 2-Abu
  MOD_RES (13)..(13): Pra
  C-term Amide

SEQ ID NO: 1800 - protein, 34 aa, Artificial Sequence; identical to SEQ ID NO: 1742
  Description of Artificial Sequence: Synthetic polypeptide
  MOD_RES (5)..(5): Nva
  MOD_RES (13)..(13): Pra
  C-term Amide

SEQ ID NO: 1801 - protein, 34 aa, Artificial Sequence; identical to SEQ ID NO: 1742
  Description of Artificial Sequence: Synthetic polypeptide
  MOD_RES (5)..(5): Nle
  MOD_RES (13)..(13): Pra
  C-term Amide

SEQ ID NO: 1802 - protein, 34 aa, Artificial Sequence; identical to SEQ ID NO: 1745
  Description of Artificial Sequence: Synthetic polypeptide
  MOD_RES (13)..(13): Pra
  C-term Amide

SEQ ID NO: 1803 - protein, 34 aa, Artificial Sequence; identical to SEQ ID NO: 1746
  Description of Artificial Sequence: Synthetic polypeptide
  MOD_RES (13)..(13): Pra
  C-term Amide

SEQ ID NO: 1804 - protein, 34 aa, Artificial Sequence; identical to SEQ ID NO: 1747
  Description of Artificial Sequence: Synthetic polypeptide
  MOD_RES (13)..(13): Pra
  C-term Amide

SEQ ID NO: 1805 - protein, 34 aa, Artificial Sequence; identical to SEQ ID NO: 1748
  Description of Artificial Sequence: Synthetic polypeptide
  MOD_RES (13)..(13): Pra
  C-term Amide

SEQ ID NO: 1806 - protein, 34 aa, Artificial Sequence; identical to SEQ ID NO: 1749
  Description of Artificial Sequence: Synthetic polypeptide
  MOD_RES (13)..(13): Pra
  C-term Amide

SEQ ID NO: 1807 - protein, 34 aa, Artificial Sequence; identical to SEQ ID NO: 1750
  Description of Artificial Sequence: Synthetic polypeptide
  MOD_RES (5)..(5): 2-Abu
  MOD_RES (13)..(13): Pra
  C-term Amide

SEQ ID NO: 1808 - protein, 34 aa, Artificial Sequence; identical to SEQ ID NO: 1750
  Description of Artificial Sequence: Synthetic polypeptide
  MOD_RES (5)..(5): Nva
  MOD_RES (13)..(13): Pra
  C-term Amide

SEQ ID NO: 1809 - protein, 34 aa, Artificial Sequence; identical to SEQ ID NO: 1750
  Description of Artificial Sequence: Synthetic polypeptide
  MOD_RES (5)..(5): Nle
  MOD_RES (13)..(13): Pra
  C-term Amide

SEQ ID NO: 1810 - protein, 34 aa, Artificial Sequence; identical to SEQ ID NO: 1753
  Description of Artificial Sequence: Synthetic polypeptide
  MOD_RES (13)..(13): Pra
  C-term Amide

SEQ ID NO: 1811 - protein, 34 aa, Artificial Sequence; identical to SEQ ID NO: 1754
  Description of Artificial Sequence: Synthetic polypeptide
  MOD_RES (13)..(13): Pra
  C-term Amide

SEQ ID NO: 1812 - protein, 34 aa, Artificial Sequence; identical to SEQ ID NO: 1755
  Description of Artificial Sequence: Synthetic polypeptide
  MOD_RES (13)..(13): Pra
  C-term Amide

SEQ ID NO: 1813 - protein, 34 aa, Artificial Sequence; identical to SEQ ID NO: 1756
  Description of Artificial Sequence: Synthetic polypeptide
  MOD_RES (6)..(6): Nle
  MOD_RES (13)..(13): Pra
  C-term Amide

SEQ ID NO: 1814 - protein, 34 aa, Artificial Sequence; identical to SEQ ID NO: 1757
  Description of Artificial Sequence: Synthetic polypeptide
  MOD_RES (6)..(6): Nle
  MOD_RES (13)..(13): Pra
  C-term Amide

SEQ ID NO: 1815 - protein, 34 aa, Artificial Sequence; identical to SEQ ID NO: 1758
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1816 - protein, 34 aa, Artificial Sequence; identical to SEQ ID NO: 1758
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1817 - protein, 34 aa, Artificial Sequence; identical to SEQ ID NO: 1758
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1818 - protein, 34 aa, Artificial Sequence; identical to SEQ ID NO: 1761
  Description of Artificial Sequence: Synthetic polypeptide
  MOD_RES (6)..(6): Nle
  MOD_RES (13)..(13): Pra
  C-term Amide

SEQ ID NO: 1819 - protein, 34 aa, Artificial Sequence; identical to SEQ ID NO: 1762
  Description of Artificial Sequence: Synthetic polypeptide
  MOD_RES (6)..(6): Nle
  MOD_RES (13)..(13): Pra
  C-term Amide

SEQ ID NO: 1820 - protein, 34 aa, Artificial Sequence; identical to SEQ ID NO: 1763
  Description of Artificial Sequence: Synthetic polypeptide
  MOD_RES (6)..(6): Nle
  MOD_RES (13)..(13): Pra
  C-term Amide

SEQ ID NO: 1821 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRLHDWCKYVF

SEQ ID NO: 1822 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRLHDWCKYVF

SEQ ID NO: 1823 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRLHDWCKYVF

SEQ ID NO: 1824 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRLHDWCKYVF

SEQ ID NO: 1825 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRLHDWCKYVF

SEQ ID NO: 1826 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRLHDWCKYVF

SEQ ID NO: 1827 - protein, 34 aa, Artificial Sequence; identical to SEQ ID NO: 1826
  Description of Artificial Sequence: Synthetic polypeptide
  MOD_RES (5)..(5): Nva
  MOD_RES (13)..(13): 2-Abu
  C-term Amide

SEQ ID NO: 1828 - protein, 34 aa, Artificial Sequence; identical to SEQ ID NO: 1826
  Description of Artificial Sequence: Synthetic polypeptide
  MOD_RES (5)..(5): Nle
  MOD_RES (13)..(13): 2-Abu
  C-term Amide

SEQ ID NO: 1829 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRLHDWCKYVF

SEQ ID NO: 1830 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRLHDWCKYVF

SEQ ID NO: 1831 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRLHDWCKYVF

SEQ ID NO: 1832 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRLHDWCKYVF

SEQ ID NO: 1833 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRLHDWCKYVF

SEQ ID NO: 1834 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRLHDWCKYVF

SEQ ID NO: 1835 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRLHDWCKYVF

SEQ ID NO: 1836 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRLHDWCKYVF

SEQ ID NO: 1837 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRLHDWCKYVF

SEQ ID NO: 1838 - protein, 34 aa, Artificial Sequence; identical to SEQ ID NO: 1837
  Description of Artificial Sequence: Synthetic polypeptide
  MOD_RES (5)..(5): Nva
  MOD_RES (13)..(13): 2-Abu
  C-term Amide

SEQ ID NO: 1839 - protein, 34 aa, Artificial Sequence; identical to SEQ ID NO: 1837
  Description of Artificial Sequence: Synthetic polypeptide
  MOD_RES (5)..(5): Nle
  MOD_RES (13)..(13): 2-Abu
  C-term Amide

SEQ ID NO: 1840 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRLHDWCKYVF

SEQ ID NO: 1841 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRLHDWCKYVF

SEQ ID NO: 1842 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRLHDWCKYVF

SEQ ID NO: 1843 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRLHDWCKYVF

SEQ ID NO: 1844 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRLHDWCKYVF

SEQ ID NO: 1845 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRLHDWCKYVF

SEQ ID NO: 1846 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRLHDWCKYVF

SEQ ID NO: 1847 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRLHDWCKYVF

SEQ ID NO: 1848 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRLHDWCKYVF

SEQ ID NO: 1849 - protein, 34 aa, Artificial Sequence; identical to SEQ ID NO: 1848
  Description of Artificial Sequence: Synthetic polypeptide
  MOD_RES (5)..(5): Nva
  MOD_RES (13)..(13): 2-Abu
  C-term Amide

SEQ ID NO: 1850 - protein, 34 aa, Artificial Sequence; identical to SEQ ID NO: 1848
  Description of Artificial Sequence: Synthetic polypeptide
  MOD_RES (5)..(5): Nle
  MOD_RES (13)..(13): 2-Abu
  C-term Amide

SEQ ID NO: 1851 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRLHDWCKYVF

SEQ ID NO: 1852 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRLHDWCKYVF

SEQ ID NO: 1853 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRLHDWCKYVF

SEQ ID NO: 1854 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRLHDWCKYVF

SEQ ID NO: 1855 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRLHDWCKYVF

SEQ ID NO: 1856 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRLHDWCKYVF

SEQ ID NO: 1857 - protein, 34 aa, Artificial Sequence; identical to SEQ ID NO: 1856
  Description of Artificial Sequence: Synthetic polypeptide
  MOD_RES (5)..(5): Nva
  MOD_RES (13)..(13): 2-Abu
  C-term Amide

SEQ ID NO: 1858 - protein, 34 aa, Artificial Sequence; identical to SEQ ID NO: 1856
  Description of Artificial Sequence: Synthetic polypeptide
  MOD_RES (5)..(5): Nle
  MOD_RES (13)..(13): 2-Abu
  C-term Amide

SEQ ID NO: 1859 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRLHDWCKYVF

SEQ ID NO: 1860 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRLHDWCKYVF

SEQ ID NO: 1861 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRLHDWCKYVF

SEQ ID NO: 1862 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRLHDWCKYVF

SEQ ID NO: 1863 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRLHDWCKYVF

SEQ ID NO: 1864 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSRLHDWCKYVF

SEQ ID NO: 1865 - protein, 34 aa, Artificial Sequence; identical to SEQ ID NO: 1864
  Description of Artificial Sequence: Synthetic polypeptide
  MOD_RES (5)..(5): Nva
  MOD_RES (13)..(13): 2-Abu
  C-term Amide

SEQ ID NO: 1866 - protein, 34 aa, Artificial Sequence; identical to SEQ ID NO: 1864
  Description of Artificial Sequence: Synthetic polypeptide
  MOD_RES (5)..(5): Nle
  MOD_RES (13)..(13): 2-Abu
  C-term Amide

SEQ ID NO: 1867 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRLHDWCKYVF

SEQ ID NO: 1868 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRLHDWCKYVF

SEQ ID NO: 1869 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRLHDWCKYVF

SEQ ID NO: 1870 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRLHDWCKYVF

SEQ ID NO: 1871 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRLHDWCKYVF

SEQ ID NO: 1872 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRLHDWCKYVF

SEQ ID NO: 1873 - protein, 34 aa, Artificial Sequence; identical to SEQ ID NO: 1872
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1874 - protein, 34 aa, Artificial Sequence; identical to SEQ ID NO: 1872
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1875 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRLHDWCKYVF

SEQ ID NO: 1876 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRLHDWCKYVF

SEQ ID NO: 1877 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRLHDWCKYVF

SEQ ID NO: 1878 - protein, 34 aa, Artificial Sequence; identical to SEQ ID NO: 1821
  Description of Artificial Sequence: Synthetic polypeptide
  MOD_RES (13)..(13): Pra
  C-term Amide

SEQ ID NO: 1879 - protein, 34 aa, Artificial Sequence; identical to SEQ ID NO: 1822
  Description of Artificial Sequence: Synthetic polypeptide
  MOD_RES (13)..(13): Pra
  C-term Amide

SEQ ID NO: 1880 - protein, 34 aa, Artificial Sequence; identical to SEQ ID NO: 1823
  Description of Artificial Sequence: Synthetic polypeptide
  MOD_RES (6)..(6): Nle
  MOD_RES (13)..(13): Pra
  C-term Amide

SEQ ID NO: 1881 - protein, 34 aa, Artificial Sequence; identical to SEQ ID NO: 1824
  Description of Artificial Sequence: Synthetic polypeptide
  MOD_RES (13)..(13): Pra
  C-term Amide

SEQ ID NO: 1882 - protein, 34 aa, Artificial Sequence; identical to SEQ ID NO: 1825
  Description of Artificial Sequence: Synthetic polypeptide
  MOD_RES (13)..(13): Pra
  C-term Amide

SEQ ID NO: 1883 - protein, 34 aa, Artificial Sequence; identical to SEQ ID NO: 1826
  Description of Artificial Sequence: Synthetic polypeptide
  MOD_RES (5)..(5): 2-Abu
  MOD_RES (13)..(13): Pra
  C-term Amide

SEQ ID NO: 1884 - protein, 34 aa, Artificial Sequence; identical to SEQ ID NO: 1826
  Description of Artificial Sequence: Synthetic polypeptide
  MOD_RES (5)..(5): Nva
  MOD_RES (13)..(13): Pra
  C-term Amide

SEQ ID NO: 1885 - protein, 34 aa, Artificial Sequence; identical to SEQ ID NO: 1826
  Description of Artificial Sequence: Synthetic polypeptide
  MOD_RES (5)..(5): Nle
  MOD_RES (13)..(13): Pra
  C-term Amide

SEQ ID NO: 1886 - protein, 34 aa, Artificial Sequence; identical to SEQ ID NO: 1829
  Description of Artificial Sequence: Synthetic polypeptide
  MOD_RES (13)..(13): Pra
  C-term Amide

SEQ ID NO: 1887 - protein, 34 aa, Artificial Sequence; identical to SEQ ID NO: 1830
  Description of Artificial Sequence: Synthetic polypeptide
  MOD_RES (13)..(13): Pra
  C-term Amide

SEQ ID NO: 1888 - protein, 34 aa, Artificial Sequence; identical to SEQ ID NO: 1831
  Description of Artificial Sequence: Synthetic polypeptide
  MOD_RES (13)..(13): Pra
  C-term Amide

SEQ ID NO: 1889 - protein, 34 aa, Artificial Sequence; identical to SEQ ID NO: 1832
  Description of Artificial Sequence: Synthetic polypeptide
  MOD_RES (13)..(13): Pra
  C-term Amide

SEQ ID NO: 1890 - protein, 34 aa, Artificial Sequence; identical to SEQ ID NO: 1833
  Description of Artificial Sequence: Synthetic polypeptide
  MOD_RES (13)..(13): Pra
  C-term Amide

SEQ ID NO: 1891 - protein, 34 aa, Artificial Sequence; identical to SEQ ID NO: 1834
  Description of Artificial Sequence: Synthetic polypeptide
  MOD_RES (6)..(6): Nle
  MOD_RES (13)..(13): Pra
  C-term Amide

SEQ ID NO: 1892 - protein, 34 aa, Artificial Sequence; identical to SEQ ID NO: 1835
  Description of Artificial Sequence: Synthetic polypeptide
  MOD_RES (13)..(13): Pra
  C-term Amide

SEQ ID NO: 1893 - protein, 34 aa, Artificial Sequence; identical to SEQ ID NO: 1836
  Description of Artificial Sequence: Synthetic polypeptide
  MOD_RES (13)..(13): Pra
  C-term Amide

SEQ ID NO: 1894 - protein, 34 aa, Artificial Sequence; identical to SEQ ID NO: 1837
  Description of Artificial Sequence: Synthetic polypeptide
  MOD_RES (5)..(5): 2-Abu
  MOD_RES (13)..(13): Pra
  C-term Amide

SEQ ID NO: 1895 - protein, 34 aa, Artificial Sequence; identical to SEQ ID NO: 1837
  Description of Artificial Sequence: Synthetic polypeptide
  MOD_RES (5)..(5): Nva
  MOD_RES (13)..(13): Pra
  C-term Amide

SEQ ID NO: 1896 - protein, 34 aa, Artificial Sequence; identical to SEQ ID NO: 1837
  Description of Artificial Sequence: Synthetic polypeptide
  MOD_RES (5)..(5): Nle
  MOD_RES (13)..(13): Pra
  C-term Amide

SEQ ID NO: 1897 - protein, 34 aa, Artificial Sequence; identical to SEQ ID NO: 1840
  Description of Artificial Sequence: Synthetic polypeptide
  MOD_RES (13)..(13): Pra
  C-term Amide

SEQ ID NO: 1898 - protein, 34 aa, Artificial Sequence; identical to SEQ ID NO: 1841
  Description of Artificial Sequence: Synthetic polypeptide
  MOD_RES (13)..(13): Pra
  C-term Amide

SEQ ID NO: 1899 - protein, 34 aa, Artificial Sequence; identical to SEQ ID NO: 1842
  Description of Artificial Sequence: Synthetic polypeptide
  MOD_RES (13)..(13): Pra
  C-term Amide

SEQ ID NO: 1900 - protein, 34 aa, Artificial Sequence; identical to SEQ ID NO: 1843
  Description of Artificial Sequence: Synthetic polypeptide
  MOD_RES (13)..(13): Pra
  C-term Amide

SEQ ID NO: 1901 - protein, 34 aa, Artificial Sequence; identical to SEQ ID NO: 1844
  Description of Artificial Sequence: Synthetic polypeptide
  MOD_RES (13)..(13): Pra
  C-term Amide

SEQ ID NO: 1902 - protein, 34 aa, Artificial Sequence; identical to SEQ ID NO: 1845
  Description of Artificial Sequence: Synthetic polypeptide
  MOD_RES (6)..(6): Nle
  MOD_RES (13)..(13): Pra
  C-term Amide

SEQ ID NO: 1903 - protein, 34 aa, Artificial Sequence; identical to SEQ ID NO: 1846
  Description of Artificial Sequence: Synthetic polypeptide
  MOD_RES (13)..(13): Pra
  C-term Amide

SEQ ID NO: 1904 - protein, 34 aa, Artificial Sequence; identical to SEQ ID NO: 1847
  Description of Artificial Sequence: Synthetic polypeptide
  MOD_RES (13)..(13): Pra
  C-term Amide

SEQ ID NO: 1905 - protein, 34 aa, Artificial Sequence; identical to SEQ ID NO: 1848
  Description of Artificial Sequence: Synthetic polypeptide
  MOD_RES (5)..(5): 2-Abu
  MOD_RES (13)..(13): Pra
  C-term Amide

SEQ ID NO: 1906 - protein, 34 aa, Artificial Sequence; identical to SEQ ID NO: 1848
  Description of Artificial Sequence: Synthetic polypeptide
  MOD_RES (5)..(5): Nva
  MOD_RES (13)..(13): Pra
  C-term Amide

SEQ ID NO: 1907 - protein, 34 aa, Artificial Sequence; identical to SEQ ID NO: 1848
  Description of Artificial Sequence: Synthetic polypeptide
  MOD_RES (5)..(5): Nle
  MOD_RES (13)..(13): Pra
  C-term Amide

SEQ ID NO: 1908 - protein, 34 aa, Artificial Sequence; identical to SEQ ID NO: 1851
  Description of Artificial Sequence: Synthetic polypeptide
  MOD_RES (13)..(13): Pra
  C-term Amide

SEQ ID NO: 1909 - protein, 34 aa, Artificial Sequence; identical to SEQ ID NO: 1852
  Description of Artificial Sequence: Synthetic polypeptide
  MOD_RES (13)..(13): Pra
  C-term Amide

SEQ ID NO: 1910 - protein, 34 aa, Artificial Sequence; identical to SEQ ID NO: 1853
  Description of Artificial Sequence: Synthetic polypeptide
  MOD_RES (13)..(13): Pra
  C-term Amide

SEQ ID NO: 1911 - protein, 34 aa, Artificial Sequence; identical to SEQ ID NO: 1854
  Description of Artificial Sequence: Synthetic polypeptide
  MOD_RES (13)..(13): Pra
  C-term Amide

SEQ ID NO: 1912 - protein, 34 aa, Artificial Sequence; identical to SEQ ID NO: 1855
  Description of Artificial Sequence: Synthetic polypeptide
  MOD_RES (13)..(13): Pra
  C-term Amide

SEQ ID NO: 1913 - protein, 34 aa, Artificial Sequence; identical to SEQ ID NO: 1856
  Description of Artificial Sequence: Synthetic polypeptide
  MOD_RES (5)..(5): 2-Abu
  MOD_RES (13)..(13): Pra
  C-term Amide

SEQ ID NO: 1914 - protein, 34 aa, Artificial Sequence; identical to SEQ ID NO: 1856
  Description of Artificial Sequence: Synthetic polypeptide
  MOD_RES (5)..(5): Nva
  MOD_RES (13)..(13): Pra
  C-term Amide

SEQ ID NO: 1915 - protein, 34 aa, Artificial Sequence; identical to SEQ ID NO: 1856
  Description of Artificial Sequence: Synthetic polypeptide
  MOD_RES (5)..(5): Nle
  MOD_RES (13)..(13): Pra
  C-term Amide

SEQ ID NO: 1916 - protein, 34 aa, Artificial Sequence; identical to SEQ ID NO: 1859
  Description of Artificial Sequence: Synthetic polypeptide
  MOD_RES (13)..(13): Pra
  C-term Amide

SEQ ID NO: 1917 - protein, 34 aa, Artificial Sequence; identical to SEQ ID NO: 1860
  Description of Artificial Sequence: Synthetic polypeptide
  MOD_RES (13)..(13): Pra
  C-term Amide

SEQ ID NO: 1918 - protein, 34 aa, Artificial Sequence; identical to SEQ ID NO: 1861
  Description of Artificial Sequence: Synthetic polypeptide
  MOD_RES (13)..(13): Pra
  C-term Amide

SEQ ID NO: 1919 - protein, 34 aa, Artificial Sequence; identical to SEQ ID NO: 1862
  Description of Artificial Sequence: Synthetic polypeptide
  MOD_RES (13)..(13): Pra
  C-term Amide

SEQ ID NO: 1920 - protein, 34 aa, Artificial Sequence; identical to SEQ ID NO: 1863
  Description of Artificial Sequence: Synthetic polypeptide
  MOD_RES (13)..(13): Pra
  C-term Amide

SEQ ID NO: 1921 - protein, 34 aa, Artificial Sequence; identical to SEQ ID NO: 1864
  Description of Artificial Sequence: Synthetic polypeptide
  MOD_RES (5)..(5): 2-Abu
  MOD_RES (13)..(13): Pra
  C-term Amide

SEQ ID NO: 1922 - protein, 34 aa, Artificial Sequence; identical to SEQ ID NO: 1864
  Description of Artificial Sequence: Synthetic polypeptide
  MOD_RES (5)..(5): Nva
  MOD_RES (13)..(13): Pra
  C-term Amide

SEQ ID NO: 1923 - protein, 34 aa, Artificial Sequence; identical to SEQ ID NO: 1864
  Description of Artificial Sequence: Synthetic polypeptide
  MOD_RES (5)..(5): Nle
  MOD_RES (13)..(13): Pra
  C-term Amide

SEQ ID NO: 1924 - protein, 34 aa, Artificial Sequence; identical to SEQ ID NO: 1867
  Description of Artificial Sequence: Synthetic polypeptide
  MOD_RES (13)..(13): Pra
  C-term Amide

SEQ ID NO: 1925 - protein, 34 aa, Artificial Sequence; identical to SEQ ID NO: 1868
  Description of Artificial Sequence: Synthetic polypeptide
  MOD_RES (13)..(13): Pra
  C-term Amide

SEQ ID NO: 1926 - protein, 34 aa, Artificial Sequence; identical to SEQ ID NO: 1869
  Description of Artificial Sequence: Synthetic polypeptide
  MOD_RES (13)..(13): Pra
  C-term Amide

SEQ ID NO: 1927 - protein, 34 aa, Artificial Sequence; identical to SEQ ID NO: 1870
  Description of Artificial Sequence: Synthetic polypeptide
  MOD_RES (6)..(6): Nle
  MOD_RES (13)..(13): Pra
  C-term Amide

SEQ ID NO: 1928 - protein, 34 aa, Artificial Sequence; identical to SEQ ID NO: 1871
  Description of Artificial Sequence: Synthetic polypeptide
  MOD_RES (6)..(6): Nle
  MOD_RES (13)..(13): Pra
  C-term Amide

SEQ ID NO: 1929 - protein, 34 aa, Artificial Sequence; identical to SEQ ID NO: 1872
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 1930 - protein, 34 aa, Artificial Sequence; identical to SEQ ID NO: 1872
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 1931 - protein, 34 aa, Artificial Sequence; identical to SEQ ID NO: 1872
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 1932 - protein, 34 aa, Artificial Sequence; identical to SEQ ID NO: 1875
  Description of Artificial Sequence: Synthetic polypeptide
  MOD_RES (6)..(6): Nle
  MOD_RES (13)..(13): Pra
  C-term Amide

SEQ ID NO: 1933 - protein, 34 aa, Artificial Sequence; identical to SEQ ID NO: 1876
  Description of Artificial Sequence: Synthetic polypeptide
  MOD_RES (6)..(6): Nle
  MOD_RES (13)..(13): Pra
  C-term Amide

SEQ ID NO: 1934 - protein, 34 aa, Artificial Sequence; identical to SEQ ID NO: 1877
  Description of Artificial Sequence: Synthetic polypeptide
  MOD_RES (6)..(6): Nle
  MOD_RES (13)..(13): Pra
  C-term Amide

SEQ ID NO: 1935 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRTHDWCKYVF

SEQ ID NO: 1936 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRTHDWCKYVF

SEQ ID NO: 1937 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRTHDWCKYVF

SEQ ID NO: 1938 - protein, 34 aa, Artificial Sequence; identical to SEQ ID NO: 1937
  Description of Artificial Sequence: Synthetic polypeptide
  MOD_RES (5)..(5): Nva
  MOD_RES (13)..(13): 2-Abu
  C-term Amide

SEQ ID NO: 1939 - protein, 34 aa, Artificial Sequence; identical to SEQ ID NO: 1937
  Description of Artificial Sequence: Synthetic polypeptide
  MOD_RES (5)..(5): Nle
  MOD_RES (13)..(13): 2-Abu
  C-term Amide

SEQ ID NO: 1940 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRTHDWCKYVF

SEQ ID NO: 1941 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRTHDWCKYVF

SEQ ID NO: 1942 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRTHDWCKYVF

SEQ ID NO: 1943 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRTHDWCKYVF

SEQ ID NO: 1944 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRTHDWCKYVF

SEQ ID NO: 1945 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRTHDWCKYVF

SEQ ID NO: 1946 - protein, 34 aa, Artificial Sequence; identical to SEQ ID NO: 1945
  Description of Artificial Sequence: Synthetic polypeptide
  MOD_RES (5)..(5): Nva
  MOD_RES (13)..(13): 2-Abu
  C-term Amide

SEQ ID NO: 1947 - protein, 34 aa, Artificial Sequence; identical to SEQ ID NO: 1945
  Description of Artificial Sequence: Synthetic polypeptide
  MOD_RES (5)..(5): Nle
  MOD_RES (13)..(13): 2-Abu
  C-term Amide

SEQ ID NO: 1948 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRTHDWCKYVF

SEQ ID NO: 1949 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRTHDWCKYVF

SEQ ID NO: 1950 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRTHDWCKYVF

SEQ ID NO: 1951 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRTHDWCKYVF

SEQ ID NO: 1952 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRTHDWCKYVF

SEQ ID NO: 1953 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRTHDWCKYVF

SEQ ID NO: 1954 - protein, 34 aa, Artificial Sequence; identical to SEQ ID NO: 1953
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1955 - protein, 34 aa, Artificial Sequence; identical to SEQ ID NO: 1953
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1956 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRTHDWCKYVF

SEQ ID NO: 1957 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRTHDWCKYVF

SEQ ID NO: 1958 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRTHDWCKYVF

SEQ ID NO: 1959 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRTHDWCKYVF

SEQ ID NO: 1960 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRTHDWCKYVF

SEQ ID NO: 1961 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRTHDWCKYVF

SEQ ID NO: 1962 - protein, 34 aa, Artificial Sequence; identical to SEQ ID NO: 1961
  Description of Artificial Sequence: Synthetic polypeptide
  MOD_RES (5)..(5): Nva
  MOD_RES (13)..(13): 2-Abu
  C-term Amide

SEQ ID NO: 1963 - protein, 34 aa, Artificial Sequence; identical to SEQ ID NO: 1961
  Description of Artificial Sequence: Synthetic polypeptide
  MOD_RES (5)..(5): Nle
  MOD_RES (13)..(13): 2-Abu
  C-term Amide

SEQ ID NO: 1964 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRTHDWCKYVF

SEQ ID NO: 1965 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRTHDWCKYVF

SEQ ID NO: 1966 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRTHDWCKYVF

SEQ ID NO: 1967 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRTHDWCKYVF

SEQ ID NO: 1968 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRTHDWCKYVF

SEQ ID NO: 1969 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRTHDWCKYVF

SEQ ID NO: 1970 - protein, 34 aa, Artificial Sequence; identical to SEQ ID NO: 1969
  Description of Artificial Sequence: Synthetic polypeptide
  MOD_RES (5)..(5): Nva
  MOD_RES (13)..(13): 2-Abu
  C-term Amide

SEQ ID NO: 1971 - protein, 34 aa, Artificial Sequence; identical to SEQ ID NO: 1969
  Description of Artificial Sequence: Synthetic polypeptide
  MOD_RES (5)..(5): Nle
  MOD_RES (13)..(13): 2-Abu
  C-term Amide

SEQ ID NO: 1972 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRTHDWCKYVF

SEQ ID NO: 1973 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRTHDWCKYVF

SEQ ID NO: 1974 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRTHDWCKYVF

SEQ ID NO: 1975 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRTHDWCKYVF

SEQ ID NO: 1976 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRTHDWCKYVF

SEQ ID NO: 1977 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRTHDWCKYVF

SEQ ID NO: 1978 - protein, 34 aa, Artificial Sequence; identical to SEQ ID NO: 1977
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 1979 - protein, 34 aa, Artificial Sequence; identical to SEQ ID NO: 1977
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 1980 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRTHDWCKYVF

SEQ ID NO: 1981 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRTHDWCKYVF

SEQ ID NO: 1982 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRTHDWCKYVF

SEQ ID NO: 1983 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRTHDWCKYVF

SEQ ID NO: 1984 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRTHDWCKYVF

SEQ ID NO: 1985 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRTHDWCKYVF

SEQ ID NO: 1986 - protein, 34 aa, Artificial Sequence; identical to SEQ ID NO: 1985
  Description of Artificial Sequence: Synthetic polypeptide
  MOD_RES (5)..(5): Nva
  MOD_RES (13)..(13): 2-Abu
  C-term Amide

SEQ ID NO: 1987 - protein, 34 aa, Artificial Sequence; identical to SEQ ID NO: 1985
  Description of Artificial Sequence: Synthetic polypeptide
  MOD_RES (5)..(5): Nle
  MOD_RES (13)..(13): 2-Abu
  C-term Amide

SEQ ID NO: 1988 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRTHDWCKYVF

SEQ ID NO: 1989 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRTHDWCKYVF

SEQ ID NO: 1990 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRTHDWCKYVF

SEQ ID NO: 1991 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRTHDWCKYVF

SEQ ID NO: 1992 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRTHDWCKYVF

SEQ ID NO: 1993 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRTHDWCKYVF

SEQ ID NO: 1994 - protein, 34 aa, Artificial Sequence; identical to SEQ ID NO: 1993
  Description of Artificial Sequence: Synthetic polypeptide
  MOD_RES (5)..(5): Nva
  MOD_RES (13)..(13): 2-Abu
  C-term Amide

SEQ ID NO: 1995 - protein, 34 aa, Artificial Sequence; identical to SEQ ID NO: 1993
  Description of Artificial Sequence: Synthetic polypeptide
  MOD_RES (5)..(5): Nle
  MOD_RES (13)..(13): 2-Abu
  C-term Amide

SEQ ID NO: 1996 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRTHDWCKYVF

SEQ ID NO: 1997 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRTHDWCKYVF

SEQ ID NO: 1998 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRTHDWCKYVF

SEQ ID NO: 1999 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRTHDWCKYVF

SEQ ID NO: 2000 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRTHDWCKYVF

SEQ ID NO: 2001 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRTHDWCKYVF

SEQ ID NO: 2002 - protein, 34 aa, Artificial Sequence; identical to SEQ ID NO: 2001
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2003 - protein, 34 aa, Artificial Sequence; identical to SEQ ID NO: 2001
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2004 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRTHDWCKYVF

SEQ ID NO: 2005 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRTHDWCKYVF

SEQ ID NO: 2006 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRTHDWCKYVF

SEQ ID NO: 2007 - protein, 34 aa, Artificial Sequence; identical to SEQ ID NO: 1935
  Description of Artificial Sequence: Synthetic polypeptide
  MOD_RES (13)..(13): Pra
  C-term Amide

SEQ ID NO: 2008 - protein, 34 aa, Artificial Sequence; identical to SEQ ID NO: 1936
  Description of Artificial Sequence: Synthetic polypeptide
  MOD_RES (13)..(13): Pra
  C-term Amide

SEQ ID NO: 2009 - protein, 34 aa, Artificial Sequence; identical to SEQ ID NO: 1937
  Description of Artificial Sequence: Synthetic polypeptide
  MOD_RES (5)..(5): 2-Abu
  MOD_RES (13)..(13): Pra
  C-term Amide

SEQ ID NO: 2010 - protein, 34 aa, Artificial Sequence; identical to SEQ ID NO: 1937
  Description of Artificial Sequence: Synthetic polypeptide
  MOD_RES (5)..(5): Nva
  MOD_RES (13)..(13): Pra
  C-term Amide

SEQ ID NO: 2011 - protein, 34 aa, Artificial Sequence; identical to SEQ ID NO: 1937
  Description of Artificial Sequence: Synthetic polypeptide
  MOD_RES (5)..(5): Nle
  MOD_RES (13)..(13): Pra
  C-term Amide

SEQ ID NO: 2012 - protein, 34 aa, Artificial Sequence; identical to SEQ ID NO: 1940
  Description of Artificial Sequence: Synthetic polypeptide
  MOD_RES (13)..(13): Pra
  C-term Amide

SEQ ID NO: 2013 - protein, 34 aa, Artificial Sequence; identical to SEQ ID NO: 1941
  Description of Artificial Sequence: Synthetic polypeptide
  MOD_RES (13)..(13): Pra
  C-term Amide

SEQ ID NO: 2014 - protein, 34 aa, Artificial Sequence; identical to SEQ ID NO: 1942
  Description of Artificial Sequence: Synthetic polypeptide
  MOD_RES (13)..(13): Pra
  C-term Amide

SEQ ID NO: 2015 - protein, 34 aa, Artificial Sequence; identical to SEQ ID NO: 1943
  Description of Artificial Sequence: Synthetic polypeptide
  MOD_RES (13)..(13): Pra
  C-term Amide

SEQ ID NO: 2016 - protein, 34 aa, Artificial Sequence; identical to SEQ ID NO: 1944
  Description of Artificial Sequence: Synthetic polypeptide
  MOD_RES (13)..(13): Pra
  C-term Amide

SEQ ID NO: 2017 - protein, 34 aa, Artificial Sequence; identical to SEQ ID NO: 1945
  Description of Artificial Sequence: Synthetic polypeptide
  MOD_RES (5)..(5): 2-Abu
  MOD_RES (13)..(13): Pra
  C-term Amide

SEQ ID NO: 2018 - protein, 34 aa, Artificial Sequence; identical to SEQ ID NO: 1945
  Description of Artificial Sequence: Synthetic polypeptide
  MOD_RES (5)..(5): Nva
  MOD_RES (13)..(13): Pra
  C-term Amide

SEQ ID NO: 2019 - protein, 34 aa, Artificial Sequence; identical to SEQ ID NO: 1945
  Description of Artificial Sequence: Synthetic polypeptide
  MOD_RES (5)..(5): Nle
  MOD_RES (13)..(13): Pra
  C-term Amide

SEQ ID NO: 2020 - protein, 34 aa, Artificial Sequence; identical to SEQ ID NO: 1948
  Description of Artificial Sequence: Synthetic polypeptide
  MOD_RES (13)..(13): Pra
  C-term Amide

SEQ ID NO: 2021 - protein, 34 aa, Artificial Sequence; identical to SEQ ID NO: 1949
  Description of Artificial Sequence: Synthetic polypeptide
  MOD_RES (13)..(13): Pra
  C-term Amide

SEQ ID NO: 2022 - protein, 34 aa, Artificial Sequence; identical to SEQ ID NO: 1950
  Description of Artificial Sequence: Synthetic polypeptide
  MOD_RES (13)..(13): Pra
  C-term Amide

SEQ ID NO: 2023 - protein, 34 aa, Artificial Sequence; identical to SEQ ID NO: 1951
  Description of Artificial Sequence: Synthetic polypeptide
  MOD_RES (6)..(6): Nle
  MOD_RES (13)..(13): Pra
  C-term Amide

SEQ ID NO: 2024 - protein, 34 aa, Artificial Sequence; identical to SEQ ID NO: 1952
  Description of Artificial Sequence: Synthetic polypeptide
  MOD_RES (6)..(6): Nle
  MOD_RES (13)..(13): Pra
  C-term Amide

SEQ ID NO: 2025 - protein, 34 aa, Artificial Sequence; identical to SEQ ID NO: 1953
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2026 - protein, 34 aa, Artificial Sequence; identical to SEQ ID NO: 1953
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2027 - protein, 34 aa, Artificial Sequence; identical to SEQ ID NO: 1953
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2028 - protein, 34 aa, Artificial Sequence; identical to SEQ ID NO: 1956
  Description of Artificial Sequence: Synthetic polypeptide
  MOD_RES (6)..(6): Nle
  MOD_RES (13)..(13): Pra
  C-term Amide

SEQ ID NO: 2029 - protein, 34 aa, Artificial Sequence; identical to SEQ ID NO: 1957
  Description of Artificial Sequence: Synthetic polypeptide
  MOD_RES (6)..(6): Nle
  MOD_RES (13)..(13): Pra
  C-term Amide

SEQ ID NO: 2030 - protein, 34 aa, Artificial Sequence; identical to SEQ ID NO: 1958
  Description of Artificial Sequence: Synthetic polypeptide
  MOD_RES (6)..(6): Nle
  MOD_RES (13)..(13): Pra
  C-term Amide

SEQ ID NO: 2031 - protein, 34 aa, Artificial Sequence; identical to SEQ ID NO: 1959
  Description of Artificial Sequence: Synthetic polypeptide
  MOD_RES (13)..(13): Pra
  C-term Amide

SEQ ID NO: 2032 - protein, 34 aa, Artificial Sequence; identical to SEQ ID NO: 1960
  Description of Artificial Sequence: Synthetic polypeptide
  MOD_RES (13)..(13): Pra
  C-term Amide

SEQ ID NO: 2033 - protein, 34 aa, Artificial Sequence; identical to SEQ ID NO: 1961
  Description of Artificial Sequence: Synthetic polypeptide
  MOD_RES (5)..(5): 2-Abu
  MOD_RES (13)..(13): Pra
  C-term Amide

SEQ ID NO: 2034 - protein, 34 aa, Artificial Sequence; identical to SEQ ID NO: 1961
  Description of Artificial Sequence: Synthetic polypeptide
  MOD_RES (5)..(5): Nva
  MOD_RES (13)..(13): Pra
  C-term Amide

SEQ ID NO: 2035 - protein, 34 aa, Artificial Sequence; identical to SEQ ID NO: 1961
  Description of Artificial Sequence: Synthetic polypeptide
  MOD_RES (5)..(5): Nle
  MOD_RES (13)..(13): Pra
  C-term Amide

SEQ ID NO: 2036 - protein, 34 aa, Artificial Sequence; identical to SEQ ID NO: 1964
  Description of Artificial Sequence: Synthetic polypeptide
  MOD_RES (13)..(13): Pra
  C-term Amide

SEQ ID NO: 2037 - protein, 34 aa, Artificial Sequence; identical to SEQ ID NO: 1965
  Description of Artificial Sequence: Synthetic polypeptide
  MOD_RES (13)..(13): Pra
  C-term Amide

SEQ ID NO: 2038 - protein, 34 aa, Artificial Sequence; identical to SEQ ID NO: 1966
  Description of Artificial Sequence: Synthetic polypeptide
  MOD_RES (13)..(13): Pra
  C-term Amide

SEQ ID NO: 2039 - protein, 34 aa, Artificial Sequence; identical to SEQ ID NO: 1967
  Description of Artificial Sequence: Synthetic polypeptide
  MOD_RES (13)..(13): Pra
  C-term Amide

SEQ ID NO: 2040 - protein, 34 aa, Artificial Sequence; identical to SEQ ID NO: 1968
  Description of Artificial Sequence: Synthetic polypeptide
  MOD_RES (13)..(13): Pra
  C-term Amide

SEQ ID NO: 2041 - protein, 34 aa, Artificial Sequence; identical to SEQ ID NO: 1969
  Description of Artificial Sequence: Synthetic polypeptide
  MOD_RES (5)..(5): 2-Abu
  MOD_RES (13)..(13): Pra
  C-term Amide

SEQ ID NO: 2042 - protein, 34 aa, Artificial Sequence; identical to SEQ ID NO: 1969
  Description of Artificial Sequence: Synthetic polypeptide
  MOD_RES (5)..(5): Nva
  MOD_RES (13)..(13): Pra
  C-term Amide

SEQ ID NO: 2043 - protein, 34 aa, Artificial Sequence; identical to SEQ ID NO: 1969
  Description of Artificial Sequence: Synthetic polypeptide
  MOD_RES (5)..(5): Nle
  MOD_RES (13)..(13): Pra
  C-term Amide

SEQ ID NO: 2044 - protein, 34 aa, Artificial Sequence; identical to SEQ ID NO: 1972
  Description of Artificial Sequence: Synthetic polypeptide
  MOD_RES (13)..(13): Pra
  C-term Amide

SEQ ID NO: 2045 - protein, 34 aa, Artificial Sequence; identical to SEQ ID NO: 1973
  Description of Artificial Sequence: Synthetic polypeptide
  MOD_RES (13)..(13): Pra
  C-term Amide

SEQ ID NO: 2046 - protein, 34 aa, Artificial Sequence; identical to SEQ ID NO: 1974
  Description of Artificial Sequence: Synthetic polypeptide
  MOD_RES (13)..(13): Pra
  C-term Amide

SEQ ID NO: 2047 - protein, 34 aa, Artificial Sequence; identical to SEQ ID NO: 1975
  Description of Artificial Sequence: Synthetic polypeptide
  MOD_RES (6)..(6): Nle
  MOD_RES (13)..(13): Pra
  C-term Amide

SEQ ID NO: 2048 - protein, 34 aa, Artificial Sequence; identical to SEQ ID NO: 1976
  Description of Artificial Sequence: Synthetic polypeptide
  MOD_RES (6)..(6): Nle
  MOD_RES (13)..(13): Pra
  C-term Amide

SEQ ID NO: 2049 - protein, 34 aa, Artificial Sequence; identical to SEQ ID NO: 1977
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2050 - protein, 34 aa, Artificial Sequence; identical to SEQ ID NO: 1977
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2051 - protein, 34 aa, Artificial Sequence; identical to SEQ ID NO: 1977
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2052 - protein, 34 aa, Artificial Sequence; identical to SEQ ID NO: 1980
  Description of Artificial Sequence: Synthetic polypeptide
  MOD_RES (6)..(6): Nle
  MOD_RES (13)..(13): Pra
  C-term Amide

SEQ ID NO: 2053 - protein, 34 aa, Artificial Sequence; identical to SEQ ID NO: 1981
  Description of Artificial Sequence: Synthetic polypeptide
  MOD_RES (6)..(6): Nle
  MOD_RES (13)..(13): Pra
  C-term Amide

SEQ ID NO: 2054 - protein, 34 aa, Artificial Sequence; identical to SEQ ID NO: 1982
  Description of Artificial Sequence: Synthetic polypeptide
  MOD_RES (6)..(6): Nle
  MOD_RES (13)..(13): Pra
  C-term Amide

SEQ ID NO: 2055 - protein, 34 aa, Artificial Sequence; identical to SEQ ID NO: 1983
  Description of Artificial Sequence: Synthetic polypeptide
  MOD_RES (13)..(13): Pra
  C-term Amide

SEQ ID NO: 2056 - protein, 34 aa, Artificial Sequence; identical to SEQ ID NO: 1984
  Description of Artificial Sequence: Synthetic polypeptide
  MOD_RES (13)..(13): Pra
  C-term Amide

SEQ ID NO: 2057 - protein, 34 aa, Artificial Sequence; identical to SEQ ID NO: 1985
  Description of Artificial Sequence: Synthetic polypeptide
  MOD_RES (5)..(5): 2-Abu
  MOD_RES (13)..(13): Pra
  C-term Amide

SEQ ID NO: 2058 - protein, 34 aa, Artificial Sequence; identical to SEQ ID NO: 1985
  Description of Artificial Sequence: Synthetic polypeptide
  MOD_RES (5)..(5): Nva
  MOD_RES (13)..(13): Pra
  C-term Amide

SEQ ID NO: 2059 - protein, 34 aa, Artificial Sequence; identical to SEQ ID NO: 1985
  Description of Artificial Sequence: Synthetic polypeptide
  MOD_RES (5)..(5): Nle
  MOD_RES (13)..(13): Pra
  C-term Amide

SEQ ID NO: 2060 - protein, 34 aa, Artificial Sequence; identical to SEQ ID NO: 1988
  Description of Artificial Sequence: Synthetic polypeptide
  MOD_RES (13)..(13): Pra
  C-term Amide

SEQ ID NO: 2061 - protein, 34 aa, Artificial Sequence; identical to SEQ ID NO: 1989
  Description of Artificial Sequence: Synthetic polypeptide
  MOD_RES (13)..(13): Pra
  C-term Amide

SEQ ID NO: 2062 - protein, 34 aa, Artificial Sequence; identical to SEQ ID NO: 1990
  Description of Artificial Sequence: Synthetic polypeptide
  MOD_RES (13)..(13): Pra
  C-term Amide

SEQ ID NO: 2063 - protein, 34 aa, Artificial Sequence; identical to SEQ ID NO: 1991
  Description of Artificial Sequence: Synthetic polypeptide
  MOD_RES (13)..(13): Pra
  C-term Amide

SEQ ID NO: 2064 - protein, 34 aa, Artificial Sequence; identical to SEQ ID NO: 1992
  Description of Artificial Sequence: Synthetic polypeptide
  MOD_RES (13)..(13): Pra
  C-term Amide

SEQ ID NO: 2065 - protein, 34 aa, Artificial Sequence; identical to SEQ ID NO: 1993
  Description of Artificial Sequence: Synthetic polypeptide
  MOD_RES (5)..(5): 2-Abu
  MOD_RES (13)..(13): Pra
  C-term Amide

SEQ ID NO: 2066 - protein, 34 aa, Artificial Sequence; identical to SEQ ID NO: 1993
  Description of Artificial Sequence: Synthetic polypeptide
  MOD_RES (5)..(5): Nva
  MOD_RES (13)..(13): Pra
  C-term Amide

SEQ ID NO: 2067 - protein, 34 aa, Artificial Sequence; identical to SEQ ID NO: 1993
  Description of Artificial Sequence: Synthetic polypeptide
  MOD_RES (5)..(5): Nle
  MOD_RES (13)..(13): Pra
  C-term Amide

SEQ ID NO: 2068 - protein, 34 aa, Artificial Sequence; identical to SEQ ID NO: 1996
  Description of Artificial Sequence: Synthetic polypeptide
  MOD_RES (13)..(13): Pra
  C-term Amide

SEQ ID NO: 2069 - protein, 34 aa, Artificial Sequence; identical to SEQ ID NO: 1997
  Description of Artificial Sequence: Synthetic polypeptide
  MOD_RES (13)..(13): Pra
  C-term Amide

SEQ ID NO: 2070 - protein, 34 aa, Artificial Sequence; identical to SEQ ID NO: 1998
  Description of Artificial Sequence: Synthetic polypeptide
  MOD_RES (13)..(13): Pra
  C-term Amide

SEQ ID NO: 2071 - protein, 34 aa, Artificial Sequence; identical to SEQ ID NO: 1999
  Description of Artificial Sequence: Synthetic polypeptide
  MOD_RES (6)..(6): Nle
  MOD_RES (13)..(13): Pra
  C-term Amide

SEQ ID NO: 2072 - protein, 34 aa, Artificial Sequence; identical to SEQ ID NO: 2000
  Description of Artificial Sequence: Synthetic polypeptide
  MOD_RES (6)..(6): Nle
  MOD_RES (13)..(13): Pra
  C-term Amide

SEQ ID NO: 2073 - protein, 34 aa, Artificial Sequence; identical to SEQ ID NO: 2001
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2074 - protein, 34 aa, Artificial Sequence; identical to SEQ ID NO: 2001
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2075 - protein, 34 aa, Artificial Sequence; identical to SEQ ID NO: 2001
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2076 - protein, 34 aa, Artificial Sequence; identical to SEQ ID NO: 2004
  Description of Artificial Sequence: Synthetic polypeptide
  MOD_RES (6)..(6): Nle
  MOD_RES (13)..(13): Pra
  C-term Amide

SEQ ID NO: 2077 - protein, 34 aa, Artificial Sequence; identical to SEQ ID NO: 2005
  Description of Artificial Sequence: Synthetic polypeptide
  MOD_RES (6)..(6): Nle
  MOD_RES (13)..(13): Pra
  C-term Amide

SEQ ID NO: 2078 - protein, 34 aa, Artificial Sequence; identical to SEQ ID NO: 2006
  Description of Artificial Sequence: Synthetic polypeptide
  MOD_RES (6)..(6): Nle
  MOD_RES (13)..(13): Pra
  C-term Amide

SEQ ID NO: 2079 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRLHDWCKYVF

SEQ ID NO: 2080 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRLHDWCKYVF

SEQ ID NO: 2081 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRLHDWCKYVF

SEQ ID NO: 2082 - protein, 34 aa, Artificial Sequence; identical to SEQ ID NO: 2081
  Description of Artificial Sequence: Synthetic polypeptide
  MOD_RES (5)..(5): Nva
  MOD_RES (13)..(13): 2-Abu
  C-term Amide

SEQ ID NO: 2083 - protein, 34 aa, Artificial Sequence; identical to SEQ ID NO: 2081
  Description of Artificial Sequence: Synthetic polypeptide
  MOD_RES (5)..(5): Nle
  MOD_RES (13)..(13): 2-Abu
  C-term Amide

SEQ ID NO: 2084 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRLHDWCKYVF

SEQ ID NO: 2085 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRLHDWCKYVF

SEQ ID NO: 2086 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRLHDWCKYVF

SEQ ID NO: 2087 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRLHDWCKYVF

SEQ ID NO: 2088 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRLHDWCKYVF

SEQ ID NO: 2089 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRLHDWCKYVF

SEQ ID NO: 2090 - protein, 34 aa, Artificial Sequence; identical to SEQ ID NO: 2089
  Description of Artificial Sequence: Synthetic polypeptide
  MOD_RES (5)..(5): Nva
  MOD_RES (13)..(13): 2-Abu
  C-term Amide

SEQ ID NO: 2091 - protein, 34 aa, Artificial Sequence; identical to SEQ ID NO: 2089
  Description of Artificial Sequence: Synthetic polypeptide
  MOD_RES (5)..(5): Nle
  MOD_RES (13)..(13): 2-Abu
  C-term Amide

SEQ ID NO: 2092 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRLHDWCKYVF

SEQ ID NO: 2093 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRLHDWCKYVF

SEQ ID NO: 2094 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRLHDWCKYVF

SEQ ID NO: 2095 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRLHDWCKYVF

SEQ ID NO: 2096 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRLHDWCKYVF

SEQ ID NO: 2097 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRLHDWCKYVF

SEQ ID NO: 2098 - protein, 34 aa, Artificial Sequence; identical to SEQ ID NO: 2097
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2099 - protein, 34 aa, Artificial Sequence; identical to SEQ ID NO: 2097
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2100 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRLHDWCKYVF

SEQ ID NO: 2101 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRLHDWCKYVF

SEQ ID NO: 2102 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRLHDWCKYVF

SEQ ID NO: 2103 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRLHDWCKYVF

SEQ ID NO: 2104 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRLHDWCKYVF

SEQ ID NO: 2105 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRLHDWCKYVF

SEQ ID NO: 2106 - protein, 34 aa, Artificial Sequence; identical to SEQ ID NO: 2105
  Description of Artificial Sequence: Synthetic polypeptide
  MOD_RES (5)..(5): Nva
  MOD_RES (13)..(13): 2-Abu
  C-term Amide

SEQ ID NO: 2107 - protein, 34 aa, Artificial Sequence; identical to SEQ ID NO: 2105
  Description of Artificial Sequence: Synthetic polypeptide
  MOD_RES (5)..(5): Nle
  MOD_RES (13)..(13): 2-Abu
  C-term Amide

SEQ ID NO: 2108 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRLHDWCKYVF

SEQ ID NO: 2109 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRLHDWCKYVF

SEQ ID NO: 2110 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRLHDWCKYVF

SEQ ID NO: 2111 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRLHDWCKYVF

SEQ ID NO: 2112 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRLHDWCKYVF

SEQ ID NO: 2113 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRLHDWCKYVF

SEQ ID NO: 2114 - protein, 34 aa, Artificial Sequence; identical to SEQ ID NO: 2113
  Description of Artificial Sequence: Synthetic polypeptide
  MOD_RES (5)..(5): Nva
  MOD_RES (13)..(13): 2-Abu
  C-term Amide

SEQ ID NO: 2115 - protein, 34 aa, Artificial Sequence; identical to SEQ ID NO: 2113
  Description of Artificial Sequence: Synthetic polypeptide
  MOD_RES (5)..(5): Nle
  MOD_RES (13)..(13): 2-Abu
  C-term Amide

SEQ ID NO: 2116 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRLHDWCKYVF

SEQ ID NO: 2117 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRLHDWCKYVF

SEQ ID NO: 2118 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRLHDWCKYVF

SEQ ID NO: 2119 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRLHDWCKYVF

SEQ ID NO: 2120 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRLHDWCKYVF

SEQ ID NO: 2121 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRLHDWCKYVF

SEQ ID NO: 2122 - protein, 34 aa, Artificial Sequence; identical to SEQ ID NO: 2121
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2123 - protein, 34 aa, Artificial Sequence; identical to SEQ ID NO: 2121
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2124 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRLHDWCKYVF

SEQ ID NO: 2125 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRLHDWCKYVF

SEQ ID NO: 2126 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRLHDWCKYVF

SEQ ID NO: 2127 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRLHDWCKYVF

SEQ ID NO: 2128 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRLHDWCKYVF

SEQ ID NO: 2129 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRLHDWCKYVF

SEQ ID NO: 2130 - protein, 34 aa, Artificial Sequence; identical to SEQ ID NO: 2129
  Description of Artificial Sequence: Synthetic polypeptide
  MOD_RES (5)..(5): Nva
  MOD_RES (13)..(13): 2-Abu
  C-term Amide

SEQ ID NO: 2131 - protein, 34 aa, Artificial Sequence; identical to SEQ ID NO: 2129
  Description of Artificial Sequence: Synthetic polypeptide
  MOD_RES (5)..(5): Nle
  MOD_RES (13)..(13): 2-Abu
  C-term Amide

SEQ ID NO: 2132 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRLHDWCKYVF

SEQ ID NO: 2133 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRLHDWCKYVF

SEQ ID NO: 2134 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRLHDWCKYVF

SEQ ID NO: 2135 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRLHDWCKYVF

SEQ ID NO: 2136 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRLHDWCKYVF

SEQ ID NO: 2137 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRLHDWCKYVF

SEQ ID NO: 2138 - protein, 34 aa, Artificial Sequence; identical to SEQ ID NO: 2137
  Description of Artificial Sequence: Synthetic polypeptide
  MOD_RES (5)..(5): Nva
  MOD_RES (13)..(13): 2-Abu
  C-term Amide

SEQ ID NO: 2139 - protein, 34 aa, Artificial Sequence; identical to SEQ ID NO: 2137
  Description of Artificial Sequence: Synthetic polypeptide
  MOD_RES (5)..(5): Nle
  MOD_RES (13)..(13): 2-Abu
  C-term Amide

SEQ ID NO: 2140 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRLHDWCKYVF

SEQ ID NO: 2141 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRLHDWCKYVF

SEQ ID NO: 2142 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRLHDWCKYVF

SEQ ID NO: 2143 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRLHDWCKYVF

SEQ ID NO: 2144 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRLHDWCKYVF

SEQ ID NO: 2145 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRLHDWCKYVF

SEQ ID NO: 2146 - protein, 34 aa, Artificial Sequence; identical to SEQ ID NO: 2145
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2147 - protein, 34 aa, Artificial Sequence; identical to SEQ ID NO: 2145
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2148 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRLHDWCKYVF

SEQ ID NO: 2149 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRLHDWCKYVF

SEQ ID NO: 2150 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRLHDWCKYVF

SEQ ID NO: 2151 - protein, 34 aa, Artificial Sequence; identical to SEQ ID NO: 2079
  Description of Artificial Sequence: Synthetic polypeptide
  MOD_RES (13)..(13): Pra
  C-term Amide

SEQ ID NO: 2152 - protein, 34 aa, Artificial Sequence; identical to SEQ ID NO: 2080
  Description of Artificial Sequence: Synthetic polypeptide
  MOD_RES (13)..(13): Pra
  C-term Amide

SEQ ID NO: 2153 - protein, 34 aa, Artificial Sequence; identical to SEQ ID NO: 2081
  Description of Artificial Sequence: Synthetic polypeptide
  MOD_RES (5)..(5): 2-Abu
  MOD_RES (13)..(13): Pra
  C-term Amide

SEQ ID NO: 2154 - protein, 34 aa, Artificial Sequence; identical to SEQ ID NO: 2081
  Description of Artificial Sequence: Synthetic polypeptide
  MOD_RES (5)..(5): Nva
  MOD_RES (13)..(13): Pra
  C-term Amide

SEQ ID NO: 2155 - protein, 34 aa, Artificial Sequence; identical to SEQ ID NO: 2081
  Description of Artificial Sequence: Synthetic polypeptide
  MOD_RES (5)..(5): Nle
  MOD_RES (13)..(13): Pra
  C-term Amide

SEQ ID NO: 2156 - protein, 34 aa, Artificial Sequence; identical to SEQ ID NO: 2084
  Description of Artificial Sequence: Synthetic polypeptide
  MOD_RES (13)..(13): Pra
  C-term Amide

SEQ ID NO: 2157 - protein, 34 aa, Artificial Sequence; identical to SEQ ID NO: 2085
  Description of Artificial Sequence: Synthetic polypeptide
  MOD_RES (13)..(13): Pra
  C-term Amide

SEQ ID NO: 2158 - protein, 34 aa, Artificial Sequence; identical to SEQ ID NO: 2086
  Description of Artificial Sequence: Synthetic polypeptide
  MOD_RES (13)..(13): Pra
  C-term Amide

SEQ ID NO: 2159 - protein, 34 aa, Artificial Sequence; identical to SEQ ID NO: 2087
  Description of Artificial Sequence: Synthetic polypeptide
  MOD_RES (13)..(13): Pra
  C-term Amide

SEQ ID NO: 2160 - protein, 34 aa, Artificial Sequence; identical to SEQ ID NO: 2088
  Description of Artificial Sequence: Synthetic polypeptide
  MOD_RES (13)..(13): Pra
  C-term Amide

SEQ ID NO: 2161 - protein, 34 aa, Artificial Sequence; identical to SEQ ID NO: 2089
  Description of Artificial Sequence: Synthetic polypeptide
  MOD_RES (5)..(5): 2-Abu
  MOD_RES (13)..(13): Pra
  C-term Amide

SEQ ID NO: 2162 - protein, 34 aa, Artificial Sequence; identical to SEQ ID NO: 2089
  Description of Artificial Sequence: Synthetic polypeptide
  MOD_RES (5)..(5): Nva
  MOD_RES (13)..(13): Pra
  C-term Amide

SEQ ID NO: 2163 - protein, 34 aa, Artificial Sequence; identical to SEQ ID NO: 2089
  Description of Artificial Sequence: Synthetic polypeptide
  MOD_RES (5)..(5): Nle
  MOD_RES (13)..(13): Pra
  C-term Amide

SEQ ID NO: 2164 - protein, 34 aa, Artificial Sequence; identical to SEQ ID NO: 2092
  Description of Artificial Sequence: Synthetic polypeptide
  MOD_RES (13)..(13): Pra
  C-term Amide

SEQ ID NO: 2165 - protein, 34 aa, Artificial Sequence; identical to SEQ ID NO: 2093
  Description of Artificial Sequence: Synthetic polypeptide
  MOD_RES (13)..(13): Pra
  C-term Amide

SEQ ID NO: 2166 - protein, 34 aa, Artificial Sequence; identical to SEQ ID NO: 2094
  Description of Artificial Sequence: Synthetic polypeptide
  MOD_RES (13)..(13): Pra
  C-term Amide

SEQ ID NO: 2167 - protein, 34 aa, Artificial Sequence; identical to SEQ ID NO: 2095
  Description of Artificial Sequence: Synthetic polypeptide
  MOD_RES (6)..(6): Nle
  MOD_RES (13)..(13): Pra
  C-term Amide

SEQ ID NO: 2168 - protein, 34 aa, Artificial Sequence; identical to SEQ ID NO: 2096
  Description of Artificial Sequence: Synthetic polypeptide
  MOD_RES (6)..(6): Nle
  MOD_RES (13)..(13): Pra
  C-term Amide

SEQ ID NO: 2169 - protein, 34 aa, Artificial Sequence; identical to SEQ ID NO: 2097
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2170 - protein, 34 aa, Artificial Sequence; identical to SEQ ID NO: 2097
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2171 - protein, 34 aa, Artificial Sequence; identical to SEQ ID NO: 2097
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2172 - protein, 34 aa, Artificial Sequence; identical to SEQ ID NO: 2100
  Description of Artificial Sequence: Synthetic polypeptide
  MOD_RES (6)..(6): Nle
  MOD_RES (13)..(13): Pra
  C-term Amide

SEQ ID NO: 2173 - protein, 34 aa, Artificial Sequence; identical to SEQ ID NO: 2101
  Description of Artificial Sequence: Synthetic polypeptide
  MOD_RES (6)..(6): Nle
  MOD_RES (13)..(13): Pra
  C-term Amide

SEQ ID NO: 2174 - protein, 34 aa, Artificial Sequence; identical to SEQ ID NO: 2102
  Description of Artificial Sequence: Synthetic polypeptide
  MOD_RES (6)..(6): Nle
  MOD_RES (13)..(13): Pra
  C-term Amide

SEQ ID NO: 2175 - protein, 34 aa, Artificial Sequence; identical to SEQ ID NO: 2103
  Description of Artificial Sequence: Synthetic polypeptide
  MOD_RES (13)..(13): Pra
  C-term Amide

SEQ ID NO: 2176 - protein, 34 aa, Artificial Sequence; identical to SEQ ID NO: 2104
  Description of Artificial Sequence: Synthetic polypeptide
  MOD_RES (13)..(13): Pra
  C-term Amide

SEQ ID NO: 2177 - protein, 34 aa, Artificial Sequence; identical to SEQ ID NO: 2105
  Description of Artificial Sequence: Synthetic polypeptide
  MOD_RES (5)..(5): 2-Abu
  MOD_RES (13)..(13): Pra
  C-term Amide

SEQ ID NO: 2178 - protein, 34 aa, Artificial Sequence; identical to SEQ ID NO: 2105
  Description of Artificial Sequence: Synthetic polypeptide
  MOD_RES (5)..(5): Nva
  MOD_RES (13)..(13): Pra
  C-term Amide

SEQ ID NO: 2179 - protein, 34 aa, Artificial Sequence; identical to SEQ ID NO: 2105
  Description of Artificial Sequence: Synthetic polypeptide
  MOD_RES (5)..(5): Nle
  MOD_RES (13)..(13): Pra
  C-term Amide

SEQ ID NO: 2180 - protein, 34 aa, Artificial Sequence; identical to SEQ ID NO: 2108
  Description of Artificial Sequence: Synthetic polypeptide
  MOD_RES (13)..(13): Pra
  C-term Amide

SEQ ID NO: 2181 - protein, 34 aa, Artificial Sequence; identical to SEQ ID NO: 2109
  Description of Artificial Sequence: Synthetic polypeptide
  MOD_RES (13)..(13): Pra
  C-term Amide

SEQ ID NO: 2182 - protein, 34 aa, Artificial Sequence; identical to SEQ ID NO: 2110
  Description of Artificial Sequence: Synthetic polypeptide
  MOD_RES (13)..(13): Pra
  C-term Amide

SEQ ID NO: 2183 - protein, 34 aa, Artificial Sequence; identical to SEQ ID NO: 2111
  Description of Artificial Sequence: Synthetic polypeptide
  MOD_RES (13)..(13): Pra
  C-term Amide

SEQ ID NO: 2184 - protein, 34 aa, Artificial Sequence; identical to SEQ ID NO: 2112
  Description of Artificial Sequence: Synthetic polypeptide
  MOD_RES (13)..(13): Pra
  C-term Amide

SEQ ID NO: 2185 - protein, 34 aa, Artificial Sequence; identical to SEQ ID NO: 2113
  Description of Artificial Sequence: Synthetic polypeptide
  MOD_RES (5)..(5): 2-Abu
  MOD_RES (13)..(13): Pra
  C-term Amide

SEQ ID NO: 2186 - protein, 34 aa, Artificial Sequence; identical to SEQ ID NO: 2113
  Description of Artificial Sequence: Synthetic polypeptide
  MOD_RES (5)..(5): Nva
  MOD_RES (13)..(13): Pra
  C-term Amide

SEQ ID NO: 2187 - protein, 34 aa, Artificial Sequence; identical to SEQ ID NO: 2113
  Description of Artificial Sequence: Synthetic polypeptide
  MOD_RES (5)..(5): Nle
  MOD_RES (13)..(13): Pra
  C-term Amide

SEQ ID NO: 2188 - protein, 34 aa, Artificial Sequence; identical to SEQ ID NO: 2116
  Description of Artificial Sequence: Synthetic polypeptide
  MOD_RES (13)..(13): Pra
  C-term Amide

SEQ ID NO: 2189 - protein, 34 aa, Artificial Sequence; identical to SEQ ID NO: 2117
  Description of Artificial Sequence: Synthetic polypeptide
  MOD_RES (13)..(13): Pra
  C-term Amide

SEQ ID NO: 2190 - protein, 34 aa, Artificial Sequence; identical to SEQ ID NO: 2118
  Description of Artificial Sequence: Synthetic polypeptide
  MOD_RES (13)..(13): Pra
  C-term Amide

SEQ ID NO: 2191 - protein, 34 aa, Artificial Sequence; identical to SEQ ID NO: 2119
  Description of Artificial Sequence: Synthetic polypeptide
  MOD_RES (6)..(6): Nle
  MOD_RES (13)..(13): Pra
  C-term Amide

SEQ ID NO: 2192 - protein, 34 aa, Artificial Sequence; identical to SEQ ID NO: 2120
  Description of Artificial Sequence: Synthetic polypeptide
  MOD_RES (6)..(6): Nle
  MOD_RES (13)..(13): Pra
  C-term Amide

SEQ ID NO: 2193 - protein, 34 aa, Artificial Sequence; identical to SEQ ID NO: 2121
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2194 - protein, 34 aa, Artificial Sequence; identical to SEQ ID NO: 2121
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2195 - protein, 34 aa, Artificial Sequence; identical to SEQ ID NO: 2121
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2196 - protein, 34 aa, Artificial Sequence; identical to SEQ ID NO: 2124
  Description of Artificial Sequence: Synthetic polypeptide
  MOD_RES (6)..(6): Nle
  MOD_RES (13)..(13): Pra
  C-term Amide

SEQ ID NO: 2197 - protein, 34 aa, Artificial Sequence; identical to SEQ ID NO: 2125
  Description of Artificial Sequence: Synthetic polypeptide
  MOD_RES (6)..(6): Nle
  MOD_RES (13)..(13): Pra
  C-term Amide

SEQ ID NO: 2198 - protein, 34 aa, Artificial Sequence; identical to SEQ ID NO: 2126
  Description of Artificial Sequence: Synthetic polypeptide
  MOD_RES (6)..(6): Nle
  MOD_RES (13)..(13): Pra
  C-term Amide

SEQ ID NO: 2199 - protein, 34 aa, Artificial Sequence; identical to SEQ ID NO: 2127
  Description of Artificial Sequence: Synthetic polypeptide
  MOD_RES (13)..(13): Pra
  C-term Amide

SEQ ID NO: 2200 - protein, 34 aa, Artificial Sequence; identical to SEQ ID NO: 2128
  Description of Artificial Sequence: Synthetic polypeptide
  MOD_RES (13)..(13): Pra
  C-term Amide

SEQ ID NO: 2201 - protein, 34 aa, Artificial Sequence; identical to SEQ ID NO: 2129
  Description of Artificial Sequence: Synthetic polypeptide
  MOD_RES (5)..(5): 2-Abu
  MOD_RES (13)..(13): Pra
  C-term Amide

SEQ ID NO: 2202 - protein, 34 aa, Artificial Sequence; identical to SEQ ID NO: 2129
  Description of Artificial Sequence: Synthetic polypeptide
  MOD_RES (5)..(5): Nva
  MOD_RES (13)..(13): Pra
  C-term Amide

SEQ ID NO: 2203 - protein, 34 aa, Artificial Sequence; identical to SEQ ID NO: 2129
  Description of Artificial Sequence: Synthetic polypeptide
  MOD_RES (5)..(5): Nle
  MOD_RES (13)..(13): Pra
  C-term Amide

SEQ ID NO: 2204 - protein, 34 aa, Artificial Sequence; identical to SEQ ID NO: 2132
  Description of Artificial Sequence: Synthetic polypeptide
  MOD_RES (13)..(13): Pra
  C-term Amide

SEQ ID NO: 2205 - protein, 34 aa, Artificial Sequence; identical to SEQ ID NO: 2133
  Description of Artificial Sequence: Synthetic polypeptide
  MOD_RES (13)..(13): Pra
  C-term Amide

SEQ ID NO: 2206 - protein, 34 aa, Artificial Sequence; identical to SEQ ID NO: 2134
  Description of Artificial Sequence: Synthetic polypeptide
  MOD_RES (13)..(13): Pra
  C-term Amide

SEQ ID NO: 2207 - protein, 34 aa, Artificial Sequence; identical to SEQ ID NO: 2135
  Description of Artificial Sequence: Synthetic polypeptide
  MOD_RES (13)..(13): Pra
  C-term Amide

SEQ ID NO: 2208 - protein, 34 aa, Artificial Sequence; identical to SEQ ID NO: 2136
  Description of Artificial Sequence: Synthetic polypeptide
  MOD_RES (13)..(13): Pra
  C-term Amide

SEQ ID NO: 2209 - protein, 34 aa, Artificial Sequence; identical to SEQ ID NO: 2137
  Description of Artificial Sequence: Synthetic polypeptide
  MOD_RES (5)..(5): 2-Abu
  MOD_RES (13)..(13): Pra
  C-term Amide

SEQ ID NO: 2210 - protein, 34 aa, Artificial Sequence; identical to SEQ ID NO: 2137
  Description of Artificial Sequence: Synthetic polypeptide
  MOD_RES (5)..(5): Nva
  MOD_RES (13)..(13): Pra
  C-term Amide

SEQ ID NO: 2211 - protein, 34 aa, Artificial Sequence; identical to SEQ ID NO: 2137
  Description of Artificial Sequence: Synthetic polypeptide
  MOD_RES (5)..(5): Nle
  MOD_RES (13)..(13): Pra
  C-term Amide

SEQ ID NO: 2212 - protein, 34 aa, Artificial Sequence; identical to SEQ ID NO: 2140
  Description of Artificial Sequence: Synthetic polypeptide
  MOD_RES (13)..(13): Pra
  C-term Amide

SEQ ID NO: 2213 - protein, 34 aa, Artificial Sequence; identical to SEQ ID NO: 2141
  Description of Artificial Sequence: Synthetic polypeptide
  MOD_RES (13)..(13): Pra
  C-term Amide

SEQ ID NO: 2214 - protein, 34 aa, Artificial Sequence; identical to SEQ ID NO: 2142
  Description of Artificial Sequence: Synthetic polypeptide
  MOD_RES (13)..(13): Pra
  C-term Amide

SEQ ID NO: 2215 - protein, 34 aa, Artificial Sequence; identical to SEQ ID NO: 2143
  Description of Artificial Sequence: Synthetic polypeptide
  MOD_RES (6)..(6): Nle
  MOD_RES (13)..(13): Pra
  C-term Amide

SEQ ID NO: 2216 - protein, 34 aa, Artificial Sequence; identical to SEQ ID NO: 2144
  Description of Artificial Sequence: Synthetic polypeptide
  MOD_RES (6)..(6): Nle
  MOD_RES (13)..(13): Pra
  C-term Amide

SEQ ID NO: 2217 - protein, 34 aa, Artificial Sequence; identical to SEQ ID NO: 2145
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2218 - protein, 34 aa, Artificial Sequence; identical to SEQ ID NO: 2145
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2219 - protein, 34 aa, Artificial Sequence; identical to SEQ ID NO: 2145
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2220 - protein, 34 aa, Artificial Sequence; identical to SEQ ID NO: 2148
  Description of Artificial Sequence: Synthetic polypeptide
  MOD_RES (6)..(6): Nle
  MOD_RES (13)..(13): Pra
  C-term Amide

SEQ ID NO: 2221 - protein, 34 aa, Artificial Sequence; identical to SEQ ID NO: 2149
  Description of Artificial Sequence: Synthetic polypeptide
  MOD_RES (6)..(6): Nle
  MOD_RES (13)..(13): Pra
  C-term Amide

SEQ ID NO: 2222 - protein, 34 aa, Artificial Sequence; identical to SEQ ID NO: 2150
  Description of Artificial Sequence: Synthetic polypeptide
  MOD_RES (6)..(6): Nle
  MOD_RES (13)..(13): Pra
  C-term Amide

SEQ ID NO: 2223 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRTHQWCKYVF

SEQ ID NO: 2224 - protein, 34 aa, Artificial Sequence; identical to SEQ ID NO: 2223
  Description of Artificial Sequence: Synthetic polypeptide
  MOD_RES (13)..(13): Pra
  C-term Amide

SEQ ID NO: 2225 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSRLHQWCKYVF

SEQ ID NO: 2226 - protein, 34 aa, Artificial Sequence; identical to SEQ ID NO: 2225
  Description of Artificial Sequence: Synthetic polypeptide
  MOD_RES (13)..(13): Pra
  C-term Amide

SEQ ID NO: 2227 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRTHQWCKYVF

SEQ ID NO: 2228 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRTHQWCKYVF

SEQ ID NO: 2229 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRTHQWCKYVF

SEQ ID NO: 2230 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRTHQWCKYVF

SEQ ID NO: 2231 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRTHQWCKYVF

SEQ ID NO: 2232 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRTHQWCKYVF

SEQ ID NO: 2233 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRTHQWCKYVF

SEQ ID NO: 2234 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRTHQWCKYVF

SEQ ID NO: 2235 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRTHQWCKYVF

SEQ ID NO: 2236 - protein, 34 aa, Artificial Sequence; identical to SEQ ID NO: 2235
  Description of Artificial Sequence: Synthetic polypeptide
  MOD_RES (5)..(5): Nva
  MOD_RES (13)..(13): 2-Abu
  C-term Amide

SEQ ID NO: 2237 - protein, 34 aa, Artificial Sequence; identical to SEQ ID NO: 2235
  Description of Artificial Sequence: Synthetic polypeptide
  MOD_RES (5)..(5): Nle
  MOD_RES (13)..(13): 2-Abu
  C-term Amide

SEQ ID NO: 2238 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRTHQWCKYVF

SEQ ID NO: 2239 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRTHQWCKYVF

SEQ ID NO: 2240 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRTHQWCKYVF

SEQ ID NO: 2241 - protein, 34 aa, Artificial Sequence; identical to SEQ ID NO: 2227
  Description of Artificial Sequence: Synthetic polypeptide
  MOD_RES (13)..(13): Pra
  C-term Amide

SEQ ID NO: 2242 - protein, 34 aa, Artificial Sequence; identical to SEQ ID NO: 2228
  Description of Artificial Sequence: Synthetic polypeptide
  MOD_RES (13)..(13): Pra
  C-term Amide

SEQ ID NO: 2243 - protein, 34 aa, Artificial Sequence; identical to SEQ ID NO: 2229
  Description of Artificial Sequence: Synthetic polypeptide
  MOD_RES (13)..(13): Pra
  C-term Amide

SEQ ID NO: 2244 - protein, 34 aa, Artificial Sequence; identical to SEQ ID NO: 2230
  Description of Artificial Sequence: Synthetic polypeptide
  MOD_RES (13)..(13): Pra
  C-term Amide

SEQ ID NO: 2245 - protein, 34 aa, Artificial Sequence; identical to SEQ ID NO: 2231
  Description of Artificial Sequence: Synthetic polypeptide
  MOD_RES (13)..(13): Pra
  C-term Amide

SEQ ID NO: 2246 - protein, 34 aa, Artificial Sequence; identical to SEQ ID NO: 2232
  Description of Artificial Sequence: Synthetic polypeptide
  MOD_RES (6)..(6): Nle
  MOD_RES (13)..(13): Pra
  C-term Amide

SEQ ID NO: 2247 - protein, 34 aa, Artificial Sequence; identical to SEQ ID NO: 2233
  Description of Artificial Sequence: Synthetic polypeptide
  MOD_RES (13)..(13): Pra
  C-term Amide

SEQ ID NO: 2248 - protein, 34 aa, Artificial Sequence; identical to SEQ ID NO: 2234
  Description of Artificial Sequence: Synthetic polypeptide
  MOD_RES (13)..(13): Pra
  C-term Amide

SEQ ID NO: 2249 - protein, 34 aa, Artificial Sequence; identical to SEQ ID NO: 2235
  Description of Artificial Sequence: Synthetic polypeptide
  MOD_RES (5)..(5): 2-Abu
  MOD_RES (13)..(13): Pra
  C-term Amide

SEQ ID NO: 2250 - protein, 34 aa, Artificial Sequence; identical to SEQ ID NO: 2235
  Description of Artificial Sequence: Synthetic polypeptide
  MOD_RES (5)..(5): Nva
  MOD_RES (13)..(13): Pra
  C-term Amide

SEQ ID NO: 2251 - protein, 34 aa, Artificial Sequence; identical to SEQ ID NO: 2235
  Description of Artificial Sequence: Synthetic polypeptide
  MOD_RES (5)..(5): Nle
  MOD_RES (13)..(13): Pra
  C-term Amide

SEQ ID NO: 2252 - protein, 34 aa, Artificial Sequence; identical to SEQ ID NO: 2238
  Description of Artificial Sequence: Synthetic polypeptide
  MOD_RES (13)..(13): Pra
  C-term Amide

SEQ ID NO: 2253 - protein, 34 aa, Artificial Sequence; identical to SEQ ID NO: 2239
  Description of Artificial Sequence: Synthetic polypeptide
  MOD_RES (13)..(13): Pra
  C-term Amide

SEQ ID NO: 2254 - protein, 34 aa, Artificial Sequence; identical to SEQ ID NO: 2240
  Description of Artificial Sequence: Synthetic polypeptide
  MOD_RES (13)..(13): Pra
  C-term Amide

SEQ ID NO: 2255 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSRLHQWCKYVF

SEQ ID NO: 2256 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSRLHQWCKYVF

SEQ ID NO: 2257 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSRLHQWCKYVF

SEQ ID NO: 2258 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSRLHQWCKYVF

SEQ ID NO: 2259 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSRLHQWCKYVF

SEQ ID NO: 2260 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSRLHQWCKYVF

SEQ ID NO: 2261 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSRLHQWCKYVF

SEQ ID NO: 2262 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSRLHQWCKYVF

SEQ ID NO: 2263 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSRLHQWCKYVF

SEQ ID NO: 2264 - protein, 34 aa, Artificial Sequence; identical to SEQ ID NO: 2263
  Description of Artificial Sequence: Synthetic polypeptide
  MOD_RES (5)..(5): Nva
  MOD_RES (13)..(13): 2-Abu
  C-term Amide

SEQ ID NO: 2265 - protein, 34 aa, Artificial Sequence; identical to SEQ ID NO: 2263
  Description of Artificial Sequence: Synthetic polypeptide
  MOD_RES (5)..(5): Nle
  MOD_RES (13)..(13): 2-Abu
  C-term Amide

SEQ ID NO: 2266 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSRLHQWCKYVF

SEQ ID NO: 2267 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSRLHQWCKYVF

SEQ ID NO: 2268 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSRLHQWCKYVF

SEQ ID NO: 2269 - protein, 34 aa, Artificial Sequence; identical to SEQ ID NO: 2255
  Description of Artificial Sequence: Synthetic polypeptide
  MOD_RES (13)..(13): Pra
  C-term Amide

SEQ ID NO: 2270 - protein, 34 aa, Artificial Sequence; identical to SEQ ID NO: 2256
  Description of Artificial Sequence: Synthetic polypeptide
  MOD_RES (13)..(13): Pra
  C-term Amide

SEQ ID NO: 2271 - protein, 34 aa, Artificial Sequence; identical to SEQ ID NO: 2257
  Description of Artificial Sequence: Synthetic polypeptide
  MOD_RES (13)..(13): Pra
  C-term Amide

SEQ ID NO: 2272 - protein, 34 aa, Artificial Sequence; identical to SEQ ID NO: 2258
  Description of Artificial Sequence: Synthetic polypeptide
  MOD_RES (13)..(13): Pra
  C-term Amide

SEQ ID NO: 2273 - protein, 34 aa, Artificial Sequence; identical to SEQ ID NO: 2259
  Description of Artificial Sequence: Synthetic polypeptide
  MOD_RES (13)..(13): Pra
  C-term Amide

SEQ ID NO: 2274 - protein, 34 aa, Artificial Sequence; identical to SEQ ID NO: 2260
  Description of Artificial Sequence: Synthetic polypeptide
  MOD_RES (6)..(6): Nle
  MOD_RES (13)..(13): Pra
  C-term Amide

SEQ ID NO: 2275 - protein, 34 aa, Artificial Sequence; identical to SEQ ID NO: 2261
  Description of Artificial Sequence: Synthetic polypeptide
  MOD_RES (13)..(13): Pra
  C-term Amide

SEQ ID NO: 2276 - protein, 34 aa, Artificial Sequence; identical to SEQ ID NO: 2262
  Description of Artificial Sequence: Synthetic polypeptide
  MOD_RES (13)..(13): Pra
  C-term Amide

SEQ ID NO: 2277 - protein, 34 aa, Artificial Sequence; identical to SEQ ID NO: 2263
  Description of Artificial Sequence: Synthetic polypeptide
  MOD_RES (5)..(5): 2-Abu
  MOD_RES (13)..(13): Pra
  C-term Amide

SEQ ID NO: 2278 - protein, 34 aa, Artificial Sequence; identical to SEQ ID NO: 2263
  Description of Artificial Sequence: Synthetic polypeptide
  MOD_RES (5)..(5): Nva
  MOD_RES (13)..(13): Pra
  C-term Amide

SEQ ID NO: 2279 - protein, 34 aa, Artificial Sequence; identical to SEQ ID NO: 2263
  Description of Artificial Sequence: Synthetic polypeptide
  MOD_RES (5)..(5): Nle
  MOD_RES (13)..(13): Pra
  C-term Amide

SEQ ID NO: 2280 - protein, 34 aa, Artificial Sequence; identical to SEQ ID NO: 2266
  Description of Artificial Sequence: Synthetic polypeptide
  MOD_RES (13)..(13): Pra
  C-term Amide

SEQ ID NO: 2281 - protein, 34 aa, Artificial Sequence; identical to SEQ ID NO: 2267
  Description of Artificial Sequence: Synthetic polypeptide
  MOD_RES (13)..(13): Pra
  C-term Amide

SEQ ID NO: 2282 - protein, 34 aa, Artificial Sequence; identical to SEQ ID NO: 2268
  Description of Artificial Sequence: Synthetic polypeptide
  MOD_RES (13)..(13): Pra
  C-term Amide

SEQ ID NO: 2283 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRTHQWCKYVF

SEQ ID NO: 2284 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRTHQWCKYVF

SEQ ID NO: 2285 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRTHQWCKYVF

SEQ ID NO: 2286 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRTHQWCKYVF

SEQ ID NO: 2287 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRTHQWCKYVF

SEQ ID NO: 2288 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRTHQWCKYVF

SEQ ID NO: 2289 - protein, 34 aa, Artificial Sequence; identical to SEQ ID NO: 2288
  Description of Artificial Sequence: Synthetic polypeptide
  MOD_RES (5)..(5): Nva
  MOD_RES (13)..(13): 2-Abu
  C-term Amide

SEQ ID NO: 2290 - protein, 34 aa, Artificial Sequence; identical to SEQ ID NO: 2288
  Description of Artificial Sequence: Synthetic polypeptide
  MOD_RES (5)..(5): Nle
  MOD_RES (13)..(13): 2-Abu
  C-term Amide

SEQ ID NO: 2291 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRTHQWCKYVF

SEQ ID NO: 2292 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRTHQWCKYVF

SEQ ID NO: 2293 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRTHQWCKYVF

SEQ ID NO: 2294 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRTHQWCKYVF

SEQ ID NO: 2295 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRTHQWCKYVF

SEQ ID NO: 2296 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRTHQWCKYVF

SEQ ID NO: 2297 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRTHQWCKYVF

SEQ ID NO: 2298 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRTHQWCKYVF

SEQ ID NO: 2299 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRTHQWCKYVF

SEQ ID NO: 2300 - protein, 34 aa, Artificial Sequence; identical to SEQ ID NO: 2299
  Description of Artificial Sequence: Synthetic polypeptide
  MOD_RES (5)..(5): Nva
  MOD_RES (13)..(13): 2-Abu
  C-term Amide

SEQ ID NO: 2301 - protein, 34 aa, Artificial Sequence; identical to SEQ ID NO: 2299
  Description of Artificial Sequence: Synthetic polypeptide
  MOD_RES (5)..(5): Nle
  MOD_RES (13)..(13): 2-Abu
  C-term Amide

SEQ ID NO: 2302 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRTHQWCKYVF

SEQ ID NO: 2303 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRTHQWCKYVF

SEQ ID NO: 2304 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRTHQWCKYVF

SEQ ID NO: 2305 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRTHQWCKYVF

SEQ ID NO: 2306 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRTHQWCKYVF

SEQ ID NO: 2307 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRTHQWCKYVF

SEQ ID NO: 2308 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRTHQWCKYVF

SEQ ID NO: 2309 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRTHQWCKYVF

SEQ ID NO: 2310 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRTHQWCKYVF

SEQ ID NO: 2311 - protein, 34 aa, Artificial Sequence; identical to SEQ ID NO: 2310
  Description of Artificial Sequence: Synthetic polypeptide
  MOD_RES (5)..(5): Nva
  MOD_RES (13)..(13): 2-Abu
  C-term Amide

SEQ ID NO: 2312 - protein, 34 aa, Artificial Sequence; identical to SEQ ID NO: 2310
  Description of Artificial Sequence: Synthetic polypeptide
  MOD_RES (5)..(5): Nle
  MOD_RES (13)..(13): 2-Abu
  C-term Amide

SEQ ID NO: 2313 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRTHQWCKYVF

SEQ ID NO: 2314 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRTHQWCKYVF

SEQ ID NO: 2315 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRTHQWCKYVF

SEQ ID NO: 2316 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRTHQWCKYVF

SEQ ID NO: 2317 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRTHQWCKYVF

SEQ ID NO: 2318 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRTHQWCKYVF

SEQ ID NO: 2319 - protein, 34 aa, Artificial Sequence; identical to SEQ ID NO: 2318
  Description of Artificial Sequence: Synthetic polypeptide
  MOD_RES (5)..(5): Nva
  MOD_RES (13)..(13): 2-Abu
  C-term Amide

SEQ ID NO: 2320 - protein, 34 aa, Artificial Sequence; identical to SEQ ID NO: 2318
  Description of Artificial Sequence: Synthetic polypeptide
  MOD_RES (5)..(5): Nle
  MOD_RES (13)..(13): 2-Abu
  C-term Amide

SEQ ID NO: 2321 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRTHQWCKYVF

SEQ ID NO: 2322 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRTHQWCKYVF

SEQ ID NO: 2323 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRTHQWCKYVF

SEQ ID NO: 2324 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRTHQWCKYVF

SEQ ID NO: 2325 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRTHQWCKYVF

SEQ ID NO: 2326 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSRTHQWCKYVF

SEQ ID NO: 2327 - protein, 34 aa, Artificial Sequence; identical to SEQ ID NO: 2326
  Description of Artificial Sequence: Synthetic polypeptide
  MOD_RES (5)..(5): Nva
  MOD_RES (13)..(13): 2-Abu
  C-term Amide

SEQ ID NO: 2328 - protein, 34 aa, Artificial Sequence; identical to SEQ ID NO: 2326
  Description of Artificial Sequence: Synthetic polypeptide
  MOD_RES (5)..(5): Nle
  MOD_RES (13)..(13): 2-Abu
  C-term Amide

SEQ ID NO: 2329 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRTHQWCKYVF

SEQ ID NO: 2330 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRTHQWCKYVF

SEQ ID NO: 2331 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRTHQWCKYVF

SEQ ID NO: 2332 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRTHQWCKYVF

SEQ ID NO: 2333 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRTHQWCKYVF

SEQ ID NO: 2334 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRTHQWCKYVF

SEQ ID NO: 2335 - protein, 34 aa, Artificial Sequence; identical to SEQ ID NO: 2334
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2336 - protein, 34 aa, Artificial Sequence; identical to SEQ ID NO: 2334
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2337 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRTHQWCKYVF

SEQ ID NO: 2338 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRTHQWCKYVF

SEQ ID NO: 2339 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRTHQWCKYVF

SEQ ID NO: 2340 - protein, 34 aa, Artificial Sequence; identical to SEQ ID NO: 2283
  Description of Artificial Sequence: Synthetic polypeptide
  MOD_RES (13)..(13): Pra
  C-term Amide

SEQ ID NO: 2341 - protein, 34 aa, Artificial Sequence; identical to SEQ ID NO: 2284
  Description of Artificial Sequence: Synthetic polypeptide
  MOD_RES (13)..(13): Pra
  C-term Amide

SEQ ID NO: 2342 - protein, 34 aa, Artificial Sequence; identical to SEQ ID NO: 2285
  Description of Artificial Sequence: Synthetic polypeptide
  MOD_RES (6)..(6): Nle
  MOD_RES (13)..(13): Pra
  C-term Amide

SEQ ID NO: 2343 - protein, 34 aa, Artificial Sequence; identical to SEQ ID NO: 2286
  Description of Artificial Sequence: Synthetic polypeptide
  MOD_RES (13)..(13): Pra
  C-term Amide

SEQ ID NO: 2344 - protein, 34 aa, Artificial Sequence; identical to SEQ ID NO: 2287
  Description of Artificial Sequence: Synthetic polypeptide
  MOD_RES (13)..(13): Pra
  C-term Amide

SEQ ID NO: 2345 - protein, 34 aa, Artificial Sequence; identical to SEQ ID NO: 2288
  Description of Artificial Sequence: Synthetic polypeptide
  MOD_RES (5)..(5): 2-Abu
  MOD_RES (13)..(13): Pra
  C-term Amide

SEQ ID NO: 2346 - protein, 34 aa, Artificial Sequence; identical to SEQ ID NO: 2288
  Description of Artificial Sequence: Synthetic polypeptide
  MOD_RES (5)..(5): Nva
  MOD_RES (13)..(13): Pra
  C-term Amide

SEQ ID NO: 2347 - protein, 34 aa, Artificial Sequence; identical to SEQ ID NO: 2288
  Description of Artificial Sequence: Synthetic polypeptide
  MOD_RES (5)..(5): Nle
  MOD_RES (13)..(13): Pra
  C-term Amide

SEQ ID NO: 2348 - protein, 34 aa, Artificial Sequence; identical to SEQ ID NO: 2291
  Description of Artificial Sequence: Synthetic polypeptide
  MOD_RES (13)..(13): Pra
  C-term Amide

SEQ ID NO: 2349 - protein, 34 aa, Artificial Sequence; identical to SEQ ID NO: 2292
  Description of Artificial Sequence: Synthetic polypeptide
  MOD_RES (13)..(13): Pra
  C-term Amide

SEQ ID NO: 2350 - protein, 34 aa, Artificial Sequence; identical to SEQ ID NO: 2293
  Description of Artificial Sequence: Synthetic polypeptide
  MOD_RES (13)..(13): Pra
  C-term Amide

SEQ ID NO: 2351 - protein, 34 aa, Artificial Sequence; identical to SEQ ID NO: 2294
  Description of Artificial Sequence: Synthetic polypeptide
  MOD_RES (13)..(13): Pra
  C-term Amide

SEQ ID NO: 2352 - protein, 34 aa, Artificial Sequence; identical to SEQ ID NO: 2295
  Description of Artificial Sequence: Synthetic polypeptide
  MOD_RES (13)..(13): Pra
  C-term Amide

SEQ ID NO: 2353 - protein, 34 aa, Artificial Sequence; identical to SEQ ID NO: 2296
  Description of Artificial Sequence: Synthetic polypeptide
  MOD_RES (6)..(6): Nle
  MOD_RES (13)..(13): Pra
  C-term Amide

SEQ ID NO: 2354 - protein, 34 aa, Artificial Sequence; identical to SEQ ID NO: 2297
  Description of Artificial Sequence: Synthetic polypeptide
  MOD_RES (13)..(13): Pra
  C-term Amide

SEQ ID NO: 2355 - protein, 34 aa, Artificial Sequence; identical to SEQ ID NO: 2298
  Description of Artificial Sequence: Synthetic polypeptide
  MOD_RES (13)..(13): Pra
  C-term Amide

SEQ ID NO: 2356 - protein, 34 aa, Artificial Sequence; identical to SEQ ID NO: 2299
  Description of Artificial Sequence: Synthetic polypeptide
  MOD_RES (5)..(5): 2-Abu
  MOD_RES (13)..(13): Pra
  C-term Amide

SEQ ID NO: 2357 - protein, 34 aa, Artificial Sequence; identical to SEQ ID NO: 2299
  Description of Artificial Sequence: Synthetic polypeptide
  MOD_RES (5)..(5): Nva
  MOD_RES (13)..(13): Pra
  C-term Amide

SEQ ID NO: 2358 - protein, 34 aa, Artificial Sequence; identical to SEQ ID NO: 2299
  Description of Artificial Sequence: Synthetic polypeptide
  MOD_RES (5)..(5): Nle
  MOD_RES (13)..(13): Pra
  C-term Amide

SEQ ID NO: 2359 - protein, 34 aa, Artificial Sequence; identical to SEQ ID NO: 2302
  Description of Artificial Sequence: Synthetic polypeptide
  MOD_RES (13)..(13): Pra
  C-term Amide

SEQ ID NO: 2360 - protein, 34 aa, Artificial Sequence; identical to SEQ ID NO: 2303
  Description of Artificial Sequence: Synthetic polypeptide
  MOD_RES (13)..(13): Pra
  C-term Amide

SEQ ID NO: 2361 - protein, 34 aa, Artificial Sequence; identical to SEQ ID NO: 2304
  Description of Artificial Sequence: Synthetic polypeptide
  MOD_RES (13)..(13): Pra
  C-term Amide

SEQ ID NO: 2362 - protein, 34 aa, Artificial Sequence; identical to SEQ ID NO: 2305
  Description of Artificial Sequence: Synthetic polypeptide
  MOD_RES (13)..(13): Pra
  C-term Amide

SEQ ID NO: 2363 - protein, 34 aa, Artificial Sequence; identical to SEQ ID NO: 2306
  Description of Artificial Sequence: Synthetic polypeptide
  MOD_RES (13)..(13): Pra
  C-term Amide

SEQ ID NO: 2364 - protein, 34 aa, Artificial Sequence; identical to SEQ ID NO: 2307
  Description of Artificial Sequence: Synthetic polypeptide
  MOD_RES (6)..(6): Nle
  MOD_RES (13)..(13): Pra
  C-term Amide

SEQ ID NO: 2365 - protein, 34 aa, Artificial Sequence; identical to SEQ ID NO: 2308
  Description of Artificial Sequence: Synthetic polypeptide
  MOD_RES (13)..(13): Pra
  C-term Amide

SEQ ID NO: 2366 - protein, 34 aa, Artificial Sequence; identical to SEQ ID NO: 2309
  Description of Artificial Sequence: Synthetic polypeptide
  MOD_RES (13)..(13): Pra
  C-term Amide

SEQ ID NO: 2367 - protein, 34 aa, Artificial Sequence; identical to SEQ ID NO: 2310
  Description of Artificial Sequence: Synthetic polypeptide
  MOD_RES (5)..(5): 2-Abu
  MOD_RES (13)..(13): Pra
  C-term Amide

SEQ ID NO: 2368 - protein, 34 aa, Artificial Sequence; identical to SEQ ID NO: 2310
  Description of Artificial Sequence: Synthetic polypeptide
  MOD_RES (5)..(5): Nva
  MOD_RES (13)..(13): Pra
  C-term Amide

SEQ ID NO: 2369 - protein, 34 aa, Artificial Sequence; identical to SEQ ID NO: 2310
  Description of Artificial Sequence: Synthetic polypeptide
  MOD_RES (5)..(5): Nle
  MOD_RES (13)..(13): Pra
  C-term Amide

SEQ ID NO: 2370 - protein, 34 aa, Artificial Sequence; identical to SEQ ID NO: 2313
  Description of Artificial Sequence: Synthetic polypeptide
  MOD_RES (13)..(13): Pra
  C-term Amide

SEQ ID NO: 2371 - protein, 34 aa, Artificial Sequence; identical to SEQ ID NO: 2314
  Description of Artificial Sequence: Synthetic polypeptide
  MOD_RES (13)..(13): Pra
  C-term Amide

SEQ ID NO: 2372 - protein, 34 aa, Artificial Sequence; identical to SEQ ID NO: 2315
  Description of Artificial Sequence: Synthetic polypeptide
  MOD_RES (13)..(13): Pra
  C-term Amide

SEQ ID NO: 2373 - protein, 34 aa, Artificial Sequence; identical to SEQ ID NO: 2316
  Description of Artificial Sequence: Synthetic polypeptide
  MOD_RES (13)..(13): Pra
  C-term Amide

SEQ ID NO: 2374 - protein, 34 aa, Artificial Sequence; identical to SEQ ID NO: 2317
  Description of Artificial Sequence: Synthetic polypeptide
  MOD_RES (13)..(13): Pra
  C-term Amide

SEQ ID NO: 2375 - protein, 34 aa, Artificial Sequence; identical to SEQ ID NO: 2318
  Description of Artificial Sequence: Synthetic polypeptide
  MOD_RES (5)..(5): 2-Abu
  MOD_RES (13)..(13): Pra
  C-term Amide

SEQ ID NO: 2376 - protein, 34 aa, Artificial Sequence; identical to SEQ ID NO: 2318
  Description of Artificial Sequence: Synthetic polypeptide
  MOD_RES (5)..(5): Nva
  MOD_RES (13)..(13): Pra
  C-term Amide

SEQ ID NO: 2377 - protein, 34 aa, Artificial Sequence; identical to SEQ ID NO: 2318
  Description of Artificial Sequence: Synthetic polypeptide
  MOD_RES (5)..(5): Nle
  MOD_RES (13)..(13): Pra
  C-term Amide

SEQ ID NO: 2378 - protein, 34 aa, Artificial Sequence; identical to SEQ ID NO: 2321
  Description of Artificial Sequence: Synthetic polypeptide
  MOD_RES (13)..(13): Pra
  C-term Amide

SEQ ID NO: 2379 - protein, 34 aa, Artificial Sequence; identical to SEQ ID NO: 2322
  Description of Artificial Sequence: Synthetic polypeptide
  MOD_RES (13)..(13): Pra
  C-term Amide

SEQ ID NO: 2380 - protein, 34 aa, Artificial Sequence; identical to SEQ ID NO: 2323
  Description of Artificial Sequence: Synthetic polypeptide
  MOD_RES (13)..(13): Pra
  C-term Amide

SEQ ID NO: 2381 - protein, 34 aa, Artificial Sequence; identical to SEQ ID NO: 2324
  Description of Artificial Sequence: Synthetic polypeptide
  MOD_RES (13)..(13): Pra
  C-term Amide

SEQ ID NO: 2382 - protein, 34 aa, Artificial Sequence; identical to SEQ ID NO: 2325
  Description of Artificial Sequence: Synthetic polypeptide
  MOD_RES (13)..(13): Pra
  C-term Amide

SEQ ID NO: 2383 - protein, 34 aa, Artificial Sequence; identical to SEQ ID NO: 2326
  Description of Artificial Sequence: Synthetic polypeptide
  MOD_RES (5)..(5): 2-Abu
  MOD_RES (13)..(13): Pra
  C-term Amide

SEQ ID NO: 2384 - protein, 34 aa, Artificial Sequence; identical to SEQ ID NO: 2326
  Description of Artificial Sequence: Synthetic polypeptide
  MOD_RES (5)..(5): Nva
  MOD_RES (13)..(13): Pra
  C-term Amide

SEQ ID NO: 2385 - protein, 34 aa, Artificial Sequence; identical to SEQ ID NO: 2326
  Description of Artificial Sequence: Synthetic polypeptide
  MOD_RES (5)..(5): Nle
  MOD_RES (13)..(13): Pra
  C-term Amide

SEQ ID NO: 2386 - protein, 34 aa, Artificial Sequence; identical to SEQ ID NO: 2329
  Description of Artificial Sequence: Synthetic polypeptide
  MOD_RES (13)..(13): Pra
  C-term Amide

SEQ ID NO: 2387 - protein, 34 aa, Artificial Sequence; identical to SEQ ID NO: 2330
  Description of Artificial Sequence: Synthetic polypeptide
  MOD_RES (13)..(13): Pra
  C-term Amide

SEQ ID NO: 2388 - protein, 34 aa, Artificial Sequence; identical to SEQ ID NO: 2331
  Description of Artificial Sequence: Synthetic polypeptide
  MOD_RES (13)..(13): Pra
  C-term Amide

SEQ ID NO: 2389 - protein, 34 aa, Artificial Sequence; identical to SEQ ID NO: 2332
  Description of Artificial Sequence: Synthetic polypeptide
  MOD_RES (6)..(6): Nle
  MOD_RES (13)..(13): Pra
  C-term Amide

SEQ ID NO: 2390 - protein, 34 aa, Artificial Sequence; identical to SEQ ID NO: 2333
  Description of Artificial Sequence: Synthetic polypeptide
  MOD_RES (6)..(6): Nle
  MOD_RES (13)..(13): Pra
  C-term Amide

SEQ ID NO: 2391 - protein, 34 aa, Artificial Sequence; identical to SEQ ID NO: 2334
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2392 - protein, 34 aa, Artificial Sequence; identical to SEQ ID NO: 2334
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2393 - protein, 34 aa, Artificial Sequence; identical to SEQ ID NO: 2334
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2394 - protein, 34 aa, Artificial Sequence; identical to SEQ ID NO: 2337
  Description of Artificial Sequence: Synthetic polypeptide
  MOD_RES (6)..(6): Nle
  MOD_RES (13)..(13): Pra
  C-term Amide

SEQ ID NO: 2395 - protein, 34 aa, Artificial Sequence; identical to SEQ ID NO: 2338
  Description of Artificial Sequence: Synthetic polypeptide
  MOD_RES (6)..(6): Nle
  MOD_RES (13)..(13): Pra
  C-term Amide

SEQ ID NO: 2396 - protein, 34 aa, Artificial Sequence; identical to SEQ ID NO: 2339
  Description of Artificial Sequence: Synthetic polypeptide
  MOD_RES (6)..(6): Nle
  MOD_RES (13)..(13): Pra
  C-term Amide

SEQ ID NO: 2397 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSRLHQWCKYVF

SEQ ID NO: 2398 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSRLHQWCKYVF

SEQ ID NO: 2399 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSRLHQWCKYVF

SEQ ID NO: 2400 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSRLHQWCKYVF

SEQ ID NO: 2401 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSRLHQWCKYVF

SEQ ID NO: 2402 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSRLHQWCKYVF

SEQ ID NO: 2403 - protein, 34 aa, Artificial Sequence; identical to SEQ ID NO: 2402
  Description of Artificial Sequence: Synthetic polypeptide
  MOD_RES (5)..(5): Nva
  MOD_RES (13)..(13): 2-Abu
  C-term Amide

SEQ ID NO: 2404 - protein, 34 aa, Artificial Sequence; identical to SEQ ID NO: 2402
  Description of Artificial Sequence: Synthetic polypeptide
  MOD_RES (5)..(5): Nle
  MOD_RES (13)..(13): 2-Abu
  C-term Amide

SEQ ID NO: 2405 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSRLHQWCKYVF

SEQ ID NO: 2406 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSRLHQWCKYVF

SEQ ID NO: 2407 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSRLHQWCKYVF

SEQ ID NO: 2408 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSRLHQWCKYVF

SEQ ID NO: 2409 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSRLHQWCKYVF

SEQ ID NO: 2410 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSRLHQWCKYVF

SEQ ID NO: 2411 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSRLHQWCKYVF

SEQ ID NO: 2412 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSRLHQWCKYVF

SEQ ID NO: 2413 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSRLHQWCKYVF

SEQ ID NO: 2414 - protein, 34 aa, Artificial Sequence; identical to SEQ ID NO: 2413
  Description of Artificial Sequence: Synthetic polypeptide
  MOD_RES (5)..(5): Nva
  MOD_RES (13)..(13): 2-Abu
  C-term Amide

SEQ ID NO: 2415 - protein, 34 aa, Artificial Sequence; identical to SEQ ID NO: 2413
  Description of Artificial Sequence: Synthetic polypeptide
  MOD_RES (5)..(5): Nle
  MOD_RES (13)..(13): 2-Abu
  C-term Amide

SEQ ID NO: 2416 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSRLHQWCKYVF

SEQ ID NO: 2417 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSRLHQWCKYVF

SEQ ID NO: 2418 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSRLHQWCKYVF

SEQ ID NO: 2419 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSRLHQWCKYVF

SEQ ID NO: 2420 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSRLHQWCKYVF

SEQ ID NO: 2421 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSRLHQWCKYVF

SEQ ID NO: 2422 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSRLHQWCKYVF

SEQ ID NO: 2423 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSRLHQWCKYVF

SEQ ID NO: 2424 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSRLHQWCKYVF

SEQ ID NO: 2425 - protein, 34 aa, Artificial Sequence; identical to SEQ ID NO: 2424
  Description of Artificial Sequence: Synthetic polypeptide
  MOD_RES (5)..(5): Nva
  MOD_RES (13)..(13): 2-Abu
  C-term Amide

SEQ ID NO: 2426 - protein, 34 aa, Artificial Sequence; identical to SEQ ID NO: 2424
  Description of Artificial Sequence: Synthetic polypeptide
  MOD_RES (5)..(5): Nle
  MOD_RES (13)..(13): 2-Abu
  C-term Amide

SEQ ID NO: 2427 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSRLHQWCKYVF

SEQ ID NO: 2428 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSRLHQWCKYVF

SEQ ID NO: 2429 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSRLHQWCKYVF

SEQ ID NO: 2430 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSRLHQWCKYVF

SEQ ID NO: 2431 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSRLHQWCKYVF

SEQ ID NO: 2432 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSRLHQWCKYVF

SEQ ID NO: 2433 - protein, 34 aa, Artificial Sequence; identical to SEQ ID NO: 2432
  Description of Artificial Sequence: Synthetic polypeptide
  MOD_RES (5)..(5): Nva
  MOD_RES (13)..(13): 2-Abu
  C-term Amide

SEQ ID NO: 2434 - protein, 34 aa, Artificial Sequence; identical to SEQ ID NO: 2432
  Description of Artificial Sequence: Synthetic polypeptide
  MOD_RES (5)..(5): Nle
  MOD_RES (13)..(13): 2-Abu
  C-term Amide

SEQ ID NO: 2435 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSRLHQWCKYVF

SEQ ID NO: 2436 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSRLHQWCKYVF

SEQ ID NO: 2437 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSRLHQWCKYVF

SEQ ID NO: 2438 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSRLHQWCKYVF

SEQ ID NO: 2439 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSRLHQWCKYVF

SEQ ID NO: 2440 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSRLHQWCKYVF

SEQ ID NO: 2441 - protein, 34 aa, Artificial Sequence; identical to SEQ ID NO: 2440
  Description of Artificial Sequence: Synthetic polypeptide
  MOD_RES (5)..(5): Nva
  MOD_RES (13)..(13): 2-Abu
  C-term Amide

SEQ ID NO: 2442 - protein, 34 aa, Artificial Sequence; identical to SEQ ID NO: 2440
  Description of Artificial Sequence: Synthetic polypeptide
  MOD_RES (5)..(5): Nle
  MOD_RES (13)..(13): 2-Abu
  C-term Amide

SEQ ID NO: 2443 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSRLHQWCKYVF

SEQ ID NO: 2444 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSRLHQWCKYVF

SEQ ID NO: 2445 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSRLHQWCKYVF

SEQ ID NO: 2446 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSRLHQWCKYVF

SEQ ID NO: 2447 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSRLHQWCKYVF

SEQ ID NO: 2448 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSRLHQWCKYVF

SEQ ID NO: 2449 - protein, 34 aa, Artificial Sequence; identical to SEQ ID NO: 2448
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2450 - protein, 34 aa, Artificial Sequence; identical to SEQ ID NO: 2448
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2451 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSRLHQWCKYVF

SEQ ID NO: 2452 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSRLHQWCKYVF

SEQ ID NO: 2453 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSRLHQWCKYVF

SEQ ID NO: 2454 - protein, 34 aa, Artificial Sequence; identical to SEQ ID NO: 2397
  Description of Artificial Sequence: Synthetic polypeptide
  MOD_RES (13)..(13): Pra
  C-term Amide

SEQ ID NO: 2455 - protein, 34 aa, Artificial Sequence; identical to SEQ ID NO: 2398
  Description of Artificial Sequence: Synthetic polypeptide
  MOD_RES (13)..(13): Pra
  C-term Amide

SEQ ID NO: 2456 - protein, 34 aa, Artificial Sequence; identical to SEQ ID NO: 2399
  Description of Artificial Sequence: Synthetic polypeptide
  MOD_RES (6)..(6): Nle
  MOD_RES (13)..(13): Pra
  C-term Amide

SEQ ID NO: 2457 - protein, 34 aa, Artificial Sequence; identical to SEQ ID NO: 2400
  Description of Artificial Sequence: Synthetic polypeptide
  MOD_RES (13)..(13): Pra
  C-term Amide

SEQ ID NO: 2458 - protein, 34 aa, Artificial Sequence; identical to SEQ ID NO: 2401
  Description of Artificial Sequence: Synthetic polypeptide
  MOD_RES (13)..(13): Pra
  C-term Amide

SEQ ID NO: 2459 - protein, 34 aa, Artificial Sequence; identical to SEQ ID NO: 2402
  Description of Artificial Sequence: Synthetic polypeptide
  MOD_RES (5)..(5): 2-Abu
  MOD_RES (13)..(13): Pra
  C-term Amide

SEQ ID NO: 2460 - protein, 34 aa, Artificial Sequence; identical to SEQ ID NO: 2402
  Description of Artificial Sequence: Synthetic polypeptide
  MOD_RES (5)..(5): Nva
  MOD_RES (13)..(13): Pra
  C-term Amide

SEQ ID NO: 2461 - protein, 34 aa, Artificial Sequence; identical to SEQ ID NO: 2402
  Description of Artificial Sequence: Synthetic polypeptide
  MOD_RES (5)..(5): Nle
  MOD_RES (13)..(13): Pra
  C-term Amide

SEQ ID NO: 2462 - protein, 34 aa, Artificial Sequence; identical to SEQ ID NO: 2405
  Description of Artificial Sequence: Synthetic polypeptide
  MOD_RES (13)..(13): Pra
  C-term Amide

SEQ ID NO: 2463 - protein, 34 aa, Artificial Sequence; identical to SEQ ID NO: 2406
  Description of Artificial Sequence: Synthetic polypeptide
  MOD_RES (13)..(13): Pra
  C-term Amide

SEQ ID NO: 2464 - protein, 34 aa, Artificial Sequence; identical to SEQ ID NO: 2407
  Description of Artificial Sequence: Synthetic polypeptide
  MOD_RES (13)..(13): Pra
  C-term Amide

SEQ ID NO: 2465 - protein, 34 aa, Artificial Sequence; identical to SEQ ID NO: 2408
  Description of Artificial Sequence: Synthetic polypeptide
  MOD_RES (13)..(13): Pra
  C-term Amide

SEQ ID NO: 2466 - protein, 34 aa, Artificial Sequence; identical to SEQ ID NO: 2409
  Description of Artificial Sequence: Synthetic polypeptide
  MOD_RES (13)..(13): Pra
  C-term Amide

SEQ ID NO: 2467 - protein, 34 aa, Artificial Sequence; identical to SEQ ID NO: 2410
  Description of Artificial Sequence: Synthetic polypeptide
  MOD_RES (6)..(6): Nle
  MOD_RES (13)..(13): Pra
  C-term Amide

SEQ ID NO: 2468 - protein, 34 aa, Artificial Sequence; identical to SEQ ID NO: 2411
  Description of Artificial Sequence: Synthetic polypeptide
  MOD_RES (13)..(13): Pra
  C-term Amide

SEQ ID NO: 2469 - protein, 34 aa, Artificial Sequence; identical to SEQ ID NO: 2412
  Description of Artificial Sequence: Synthetic polypeptide
  MOD_RES (13)..(13): Pra
  C-term Amide

SEQ ID NO: 2470 - protein, 34 aa, Artificial Sequence; identical to SEQ ID NO: 2413
  Description of Artificial Sequence: Synthetic polypeptide
  MOD_RES (5)..(5): 2-Abu
  MOD_RES (13)..(13): Pra
  C-term Amide

SEQ ID NO: 2471 - protein, 34 aa, Artificial Sequence; identical to SEQ ID NO: 2413
  Description of Artificial Sequence: Synthetic polypeptide
  MOD_RES (5)..(5): Nva
  MOD_RES (13)..(13): Pra
  C-term Amide

SEQ ID NO: 2472 - protein, 34 aa, Artificial Sequence; identical to SEQ ID NO: 2413
  Description of Artificial Sequence: Synthetic polypeptide
  MOD_RES (5)..(5): Nle
  MOD_RES (13)..(13): Pra
  C-term Amide

SEQ ID NO: 2473 - protein, 34 aa, Artificial Sequence; identical to SEQ ID NO: 2416
  Description of Artificial Sequence: Synthetic polypeptide
  MOD_RES (13)..(13): Pra
  C-term Amide

SEQ ID NO: 2474 - protein, 34 aa, Artificial Sequence; identical to SEQ ID NO: 2417
  Description of Artificial Sequence: Synthetic polypeptide
  MOD_RES (13)..(13): Pra
  C-term Amide

SEQ ID NO: 2475 - protein, 34 aa, Artificial Sequence; identical to SEQ ID NO: 2418
  Description of Artificial Sequence: Synthetic polypeptide
  MOD_RES (13)..(13): Pra
  C-term Amide

SEQ ID NO: 2476 - protein, 34 aa, Artificial Sequence; identical to SEQ ID NO: 2419
  Description of Artificial Sequence: Synthetic polypeptide
  MOD_RES (13)..(13): Pra
  C-term Amide

SEQ ID NO: 2477 - protein, 34 aa, Artificial Sequence; identical to SEQ ID NO: 2420
  Description of Artificial Sequence: Synthetic polypeptide
  MOD_RES (13)..(13): Pra
  C-term Amide

SEQ ID NO: 2478 - protein, 34 aa, Artificial Sequence; identical to SEQ ID NO: 2421
  Description of Artificial Sequence: Synthetic polypeptide
  MOD_RES (6)..(6): Nle
  MOD_RES (13)..(13): Pra
  C-term Amide

SEQ ID NO: 2479 - protein, 34 aa, Artificial Sequence; identical to SEQ ID NO: 2422
  Description of Artificial Sequence: Synthetic polypeptide
  MOD_RES (13)..(13): Pra
  C-term Amide

SEQ ID NO: 2480 - protein, 34 aa, Artificial Sequence; identical to SEQ ID NO: 2423
  Description of Artificial Sequence: Synthetic polypeptide
  MOD_RES (13)..(13): Pra
  C-term Amide

SEQ ID NO: 2481 - protein, 34 aa, Artificial Sequence; identical to SEQ ID NO: 2424
  Description of Artificial Sequence: Synthetic polypeptide
  MOD_RES (5)..(5): 2-Abu
  MOD_RES (13)..(13): Pra
  C-term Amide

SEQ ID NO: 2482 - protein, 34 aa, Artificial Sequence; identical to SEQ ID NO: 2424
  Description of Artificial Sequence: Synthetic polypeptide
  MOD_RES (5)..(5): Nva
  MOD_RES (13)..(13): Pra
  C-term Amide

SEQ ID NO: 2483 - protein, 34 aa, Artificial Sequence; identical to SEQ ID NO: 2424
  Description of Artificial Sequence: Synthetic polypeptide
  MOD_RES (5)..(5): Nle
  MOD_RES (13)..(13): Pra
  C-term Amide

SEQ ID NO: 2484 - protein, 34 aa, Artificial Sequence; identical to SEQ ID NO: 2427
  Description of Artificial Sequence: Synthetic polypeptide
  MOD_RES (13)..(13): Pra
  C-term Amide

SEQ ID NO: 2485 - protein, 34 aa, Artificial Sequence; identical to SEQ ID NO: 2428
  Description of Artificial Sequence: Synthetic polypeptide
  MOD_RES (13)..(13): Pra
  C-term Amide

SEQ ID NO: 2486 - protein, 34 aa, Artificial Sequence; identical to SEQ ID NO: 2429
  Description of Artificial Sequence: Synthetic polypeptide
  MOD_RES (13)..(13): Pra
  C-term Amide

SEQ ID NO: 2487 - protein, 34 aa, Artificial Sequence; identical to SEQ ID NO: 2430
  Description of Artificial Sequence: Synthetic polypeptide
  MOD_RES (13)..(13): Pra
  C-term Amide

SEQ ID NO: 2488 - protein, 34 aa, Artificial Sequence; identical to SEQ ID NO: 2431
  Description of Artificial Sequence: Synthetic polypeptide
  MOD_RES (13)..(13): Pra
  C-term Amide

SEQ ID NO: 2489 - protein, 34 aa, Artificial Sequence; identical to SEQ ID NO: 2432
  Description of Artificial Sequence: Synthetic polypeptide
  MOD_RES (5)..(5): 2-Abu
  MOD_RES (13)..(13): Pra
  C-term Amide

SEQ ID NO: 2490 - protein, 34 aa, Artificial Sequence; identical to SEQ ID NO: 2432
  Description of Artificial Sequence: Synthetic polypeptide
  MOD_RES (5)..(5): Nva
  MOD_RES (13)..(13): Pra
  C-term Amide

SEQ ID NO: 2491 - protein, 34 aa, Artificial Sequence; identical to SEQ ID NO: 2432
  Description of Artificial Sequence: Synthetic polypeptide
  MOD_RES (5)..(5): Nle
  MOD_RES (13)..(13): Pra
  C-term Amide

SEQ ID NO: 2492 - protein, 34 aa, Artificial Sequence; identical to SEQ ID NO: 2435
  Description of Artificial Sequence: Synthetic polypeptide
  MOD_RES (13)..(13): Pra
  C-term Amide

SEQ ID NO: 2493 - protein, 34 aa, Artificial Sequence; identical to SEQ ID NO: 2436
  Description of Artificial Sequence: Synthetic polypeptide
  MOD_RES (13)..(13): Pra
  C-term Amide

SEQ ID NO: 2494 - protein, 34 aa, Artificial Sequence; identical to SEQ ID NO: 2437
  Description of Artificial Sequence: Synthetic polypeptide
  MOD_RES (13)..(13): Pra
  C-term Amide

SEQ ID NO: 2495 - protein, 34 aa, Artificial Sequence; identical to SEQ ID NO: 2438
  Description of Artificial Sequence: Synthetic polypeptide
  MOD_RES (13)..(13): Pra
  C-term Amide

SEQ ID NO: 2496 - protein, 34 aa, Artificial Sequence; identical to SEQ ID NO: 2439
  Description of Artificial Sequence: Synthetic polypeptide
  MOD_RES (13)..(13): Pra
  C-term Amide

SEQ ID NO: 2497 - protein, 34 aa, Artificial Sequence; identical to SEQ ID NO: 2440
  Description of Artificial Sequence: Synthetic polypeptide
  MOD_RES (5)..(5): 2-Abu
  MOD_RES (13)..(13): Pra
  C-term Amide

SEQ ID NO: 2498 - protein, 34 aa, Artificial Sequence; identical to SEQ ID NO: 2440
  Description of Artificial Sequence: Synthetic polypeptide
  MOD_RES (5)..(5): Nva
  MOD_RES (13)..(13): Pra
  C-term Amide

SEQ ID NO: 2499 - protein, 34 aa, Artificial Sequence; identical to SEQ ID NO: 2440
  Description of Artificial Sequence: Synthetic polypeptide
  MOD_RES (5)..(5): Nle
  MOD_RES (13)..(13): Pra
  C-term Amide

SEQ ID NO: 2500 - protein, 34 aa, Artificial Sequence; identical to SEQ ID NO: 2443
  Description of Artificial Sequence: Synthetic polypeptide
  MOD_RES (13)..(13): Pra
  C-term Amide

SEQ ID NO: 2501 - protein, 34 aa, Artificial Sequence; identical to SEQ ID NO: 2444
  Description of Artificial Sequence: Synthetic polypeptide
  MOD_RES (13)..(13): Pra
  C-term Amide

SEQ ID NO: 2502 - protein, 34 aa, Artificial Sequence; identical to SEQ ID NO: 2445
  Description of Artificial Sequence: Synthetic polypeptide
  MOD_RES (13)..(13): Pra
  C-term Amide

SEQ ID NO: 2503 - protein, 34 aa, Artificial Sequence; identical to SEQ ID NO: 2446
  Description of Artificial Sequence: Synthetic polypeptide
  MOD_RES (6)..(6): Nle
  MOD_RES (13)..(13): Pra
  C-term Amide

SEQ ID NO: 2504 - protein, 34 aa, Artificial Sequence; identical to SEQ ID NO: 2447
  Description of Artificial Sequence: Synthetic polypeptide
  MOD_RES (6)..(6): Nle
  MOD_RES (13)..(13): Pra
  C-term Amide

SEQ ID NO: 2505 - protein, 34 aa, Artificial Sequence; identical to SEQ ID NO: 2448
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2506 - protein, 34 aa, Artificial Sequence; identical to SEQ ID NO: 2448
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2507 - protein, 34 aa, Artificial Sequence; identical to SEQ ID NO: 2448
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2508 - protein, 34 aa, Artificial Sequence; identical to SEQ ID NO: 2451
  Description of Artificial Sequence: Synthetic polypeptide
  MOD_RES (6)..(6): Nle
  MOD_RES (13)..(13): Pra
  C-term Amide

SEQ ID NO: 2509 - protein, 34 aa, Artificial Sequence; identical to SEQ ID NO: 2452
  Description of Artificial Sequence: Synthetic polypeptide
  MOD_RES (6)..(6): Nle
  MOD_RES (13)..(13): Pra
  C-term Amide

SEQ ID NO: 2510 - protein, 34 aa, Artificial Sequence; identical to SEQ ID NO: 2453
  Description of Artificial Sequence: Synthetic polypeptide
  MOD_RES (6)..(6): Nle
  MOD_RES (13)..(13): Pra
  C-term Amide

SEQ ID NO: 2511 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRTHQWCKYVF

SEQ ID NO: 2512 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRTHQWCKYVF

SEQ ID NO: 2513 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRTHQWCKYVF

SEQ ID NO: 2514 - protein, 34 aa, Artificial Sequence; identical to SEQ ID NO: 2513
  Description of Artificial Sequence: Synthetic polypeptide
  MOD_RES (5)..(5): Nva
  MOD_RES (13)..(13): 2-Abu
  C-term Amide

SEQ ID NO: 2515 - protein, 34 aa, Artificial Sequence; identical to SEQ ID NO: 2513
  Description of Artificial Sequence: Synthetic polypeptide
  MOD_RES (5)..(5): Nle
  MOD_RES (13)..(13): 2-Abu
  C-term Amide

SEQ ID NO: 2516 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRTHQWCKYVF

SEQ ID NO: 2517 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRTHQWCKYVF

SEQ ID NO: 2518 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRTHQWCKYVF

SEQ ID NO: 2519 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRTHQWCKYVF

SEQ ID NO: 2520 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRTHQWCKYVF

SEQ ID NO: 2521 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRTHQWCKYVF

SEQ ID NO: 2522 - protein, 34 aa, Artificial Sequence; identical to SEQ ID NO: 2521
  Description of Artificial Sequence: Synthetic polypeptide
  MOD_RES (5)..(5): Nva
  MOD_RES (13)..(13): 2-Abu
  C-term Amide

SEQ ID NO: 2523 - protein, 34 aa, Artificial Sequence; identical to SEQ ID NO: 2521
  Description of Artificial Sequence: Synthetic polypeptide
  MOD_RES (5)..(5): Nle
  MOD_RES (13)..(13): 2-Abu
  C-term Amide

SEQ ID NO: 2524 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRTHQWCKYVF

SEQ ID NO: 2525 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRTHQWCKYVF

SEQ ID NO: 2526 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRTHQWCKYVF

SEQ ID NO: 2527 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRTHQWCKYVF

SEQ ID NO: 2528 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRTHQWCKYVF

SEQ ID NO: 2529 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRTHQWCKYVF

SEQ ID NO: 2530 - protein, 34 aa, Artificial Sequence; identical to SEQ ID NO: 2529
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2531 - protein, 34 aa, Artificial Sequence; identical to SEQ ID NO: 2529
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2532 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRTHQWCKYVF

SEQ ID NO: 2533 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRTHQWCKYVF

SEQ ID NO: 2534 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRTHQWCKYVF

SEQ ID NO: 2535 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRTHQWCKYVF

SEQ ID NO: 2536 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRTHQWCKYVF

SEQ ID NO: 2537 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRTHQWCKYVF

SEQ ID NO: 2538 - protein, 34 aa, Artificial Sequence; identical to SEQ ID NO: 2537
  Description of Artificial Sequence: Synthetic polypeptide
  MOD_RES (5)..(5): Nva
  MOD_RES (13)..(13): 2-Abu
  C-term Amide

SEQ ID NO: 2539 - protein, 34 aa, Artificial Sequence; identical to SEQ ID NO: 2537
  Description of Artificial Sequence: Synthetic polypeptide
  MOD_RES (5)..(5): Nle
  MOD_RES (13)..(13): 2-Abu
  C-term Amide

SEQ ID NO: 2540 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRTHQWCKYVF

SEQ ID NO: 2541 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRTHQWCKYVF

SEQ ID NO: 2542 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRTHQWCKYVF

SEQ ID NO: 2543 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRTHQWCKYVF

SEQ ID NO: 2544 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRTHQWCKYVF

SEQ ID NO: 2545 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRTHQWCKYVF

SEQ ID NO: 2546 - protein, 34 aa, Artificial Sequence; identical to SEQ ID NO: 2545
  Description of Artificial Sequence: Synthetic polypeptide
  MOD_RES (5)..(5): Nva
  MOD_RES (13)..(13): 2-Abu
  C-term Amide

SEQ ID NO: 2547 - protein, 34 aa, Artificial Sequence; identical to SEQ ID NO: 2545
  Description of Artificial Sequence: Synthetic polypeptide
  MOD_RES (5)..(5): Nle
  MOD_RES (13)..(13): 2-Abu
  C-term Amide

SEQ ID NO: 2548 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRTHQWCKYVF

SEQ ID NO: 2549 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRTHQWCKYVF

SEQ ID NO: 2550 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRTHQWCKYVF

SEQ ID NO: 2551 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRTHQWCKYVF

SEQ ID NO: 2552 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRTHQWCKYVF

SEQ ID NO: 2553 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRTHQWCKYVF

SEQ ID NO: 2554 - protein, 34 aa, Artificial Sequence; identical to SEQ ID NO: 2553
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2555 - protein, 34 aa, Artificial Sequence; identical to SEQ ID NO: 2553
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2556 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRTHQWCKYVF

SEQ ID NO: 2557 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRTHQWCKYVF

SEQ ID NO: 2558 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRTHQWCKYVF

SEQ ID NO: 2559 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRTHQWCKYVF

SEQ ID NO: 2560 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRTHQWCKYVF

SEQ ID NO: 2561 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRTHQWCKYVF

SEQ ID NO: 2562 - protein, 34 aa, Artificial Sequence; identical to SEQ ID NO: 2561
  Description of Artificial Sequence: Synthetic polypeptide
  MOD_RES (5)..(5): Nva
  MOD_RES (13)..(13): 2-Abu
  C-term Amide

SEQ ID NO: 2563 - protein, 34 aa, Artificial Sequence; identical to SEQ ID NO: 2561
  Description of Artificial Sequence: Synthetic polypeptide
  MOD_RES (5)..(5): Nle
  MOD_RES (13)..(13): 2-Abu
  C-term Amide

SEQ ID NO: 2564 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRTHQWCKYVF

SEQ ID NO: 2565 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRTHQWCKYVF

SEQ ID NO: 2566 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRTHQWCKYVF

SEQ ID NO: 2567 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRTHQWCKYVF

SEQ ID NO: 2568 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRTHQWCKYVF

SEQ ID NO: 2569 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRTHQWCKYVF

SEQ ID NO: 2570 - protein, 34 aa, Artificial Sequence; identical to SEQ ID NO: 2569
  Description of Artificial Sequence: Synthetic polypeptide
  MOD_RES (5)..(5): Nva
  MOD_RES (13)..(13): 2-Abu
  C-term Amide

SEQ ID NO: 2571 - protein, 34 aa, Artificial Sequence; identical to SEQ ID NO: 2569
  Description of Artificial Sequence: Synthetic polypeptide
  MOD_RES (5)..(5): Nle
  MOD_RES (13)..(13): 2-Abu
  C-term Amide

SEQ ID NO: 2572 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRTHQWCKYVF

SEQ ID NO: 2573 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRTHQWCKYVF

SEQ ID NO: 2574 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRTHQWCKYVF

SEQ ID NO: 2575 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRTHQWCKYVF

SEQ ID NO: 2576 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRTHQWCKYVF

SEQ ID NO: 2577 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRTHQWCKYVF

SEQ ID NO: 2578 - protein, 34 aa, Artificial Sequence; identical to SEQ ID NO: 2577
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2579 - protein, 34 aa, Artificial Sequence; identical to SEQ ID NO: 2577
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2580 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRTHQWCKYVF

SEQ ID NO: 2581 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRTHQWCKYVF

SEQ ID NO: 2582 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRTHQWCKYVF

SEQ ID NO: 2583 - protein, 34 aa, Artificial Sequence; identical to SEQ ID NO: 2511
  Description of Artificial Sequence: Synthetic polypeptide
  MOD_RES (13)..(13): Pra
  C-term Amide

SEQ ID NO: 2584 - protein, 34 aa, Artificial Sequence; identical to SEQ ID NO: 2512
  Description of Artificial Sequence: Synthetic polypeptide
  MOD_RES (13)..(13): Pra
  C-term Amide

SEQ ID NO: 2585 - protein, 34 aa, Artificial Sequence; identical to SEQ ID NO: 2513
  Description of Artificial Sequence: Synthetic polypeptide
  MOD_RES (5)..(5): 2-Abu
  MOD_RES (13)..(13): Pra
  C-term Amide

SEQ ID NO: 2586 - protein, 34 aa, Artificial Sequence; identical to SEQ ID NO: 2513
  Description of Artificial Sequence: Synthetic polypeptide
  MOD_RES (5)..(5): Nva
  MOD_RES (13)..(13): Pra
  C-term Amide

SEQ ID NO: 2587 - protein, 34 aa, Artificial Sequence; identical to SEQ ID NO: 2513
  Description of Artificial Sequence: Synthetic polypeptide
  MOD_RES (5)..(5): Nle
  MOD_RES (13)..(13): Pra
  C-term Amide

SEQ ID NO: 2588 - protein, 34 aa, Artificial Sequence; identical to SEQ ID NO: 2516
  Description of Artificial Sequence: Synthetic polypeptide
  MOD_RES (13)..(13): Pra
  C-term Amide

SEQ ID NO: 2589 - protein, 34 aa, Artificial Sequence; identical to SEQ ID NO: 2517
  Description of Artificial Sequence: Synthetic polypeptide
  MOD_RES (13)..(13): Pra
  C-term Amide

SEQ ID NO: 2590 - protein, 34 aa, Artificial Sequence; identical to SEQ ID NO: 2518
  Description of Artificial Sequence: Synthetic polypeptide
  MOD_RES (13)..(13): Pra
  C-term Amide

SEQ ID NO: 2591 - protein, 34 aa, Artificial Sequence; identical to SEQ ID NO: 2519
  Description of Artificial Sequence: Synthetic polypeptide
  MOD_RES (13)..(13): Pra
  C-term Amide

SEQ ID NO: 2592 - protein, 34 aa, Artificial Sequence; identical to SEQ ID NO: 2520
  Description of Artificial Sequence: Synthetic polypeptide
  MOD_RES (13)..(13): Pra
  C-term Amide

SEQ ID NO: 2593 - protein, 34 aa, Artificial Sequence; identical to SEQ ID NO: 2521
  Description of Artificial Sequence: Synthetic polypeptide
  MOD_RES (5)..(5): 2-Abu
  MOD_RES (13)..(13): Pra
  C-term Amide

SEQ ID NO: 2594 - protein, 34 aa, Artificial Sequence; identical to SEQ ID NO: 2521
  Description of Artificial Sequence: Synthetic polypeptide
  MOD_RES (5)..(5): Nva
  MOD_RES (13)..(13): Pra
  C-term Amide

SEQ ID NO: 2595 - protein, 34 aa, Artificial Sequence; identical to SEQ ID NO: 2521
  Description of Artificial Sequence: Synthetic polypeptide
  MOD_RES (5)..(5): Nle
  MOD_RES (13)..(13): Pra
  C-term Amide

SEQ ID NO: 2596 - protein, 34 aa, Artificial Sequence; identical to SEQ ID NO: 2524
  Description of Artificial Sequence: Synthetic polypeptide
  MOD_RES (13)..(13): Pra
  C-term Amide

SEQ ID NO: 2597 - protein, 34 aa, Artificial Sequence; identical to SEQ ID NO: 2525
  Description of Artificial Sequence: Synthetic polypeptide
  MOD_RES (13)..(13): Pra
  C-term Amide

SEQ ID NO: 2598 - protein, 34 aa, Artificial Sequence; identical to SEQ ID NO: 2526
  Description of Artificial Sequence: Synthetic polypeptide
  MOD_RES (13)..(13): Pra
  C-term Amide

SEQ ID NO: 2599 - protein, 34 aa, Artificial Sequence; identical to SEQ ID NO: 2527
  Description of Artificial Sequence: Synthetic polypeptide
  MOD_RES (6)..(6): Nle
  MOD_RES (13)..(13): Pra
  C-term Amide

SEQ ID NO: 2600 - protein, 34 aa, Artificial Sequence; identical to SEQ ID NO: 2528
  Description of Artificial Sequence: Synthetic polypeptide
  MOD_RES (6)..(6): Nle
  MOD_RES (13)..(13): Pra
  C-term Amide

SEQ ID NO: 2601 - protein, 34 aa, Artificial Sequence; identical to SEQ ID NO: 2529
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2602 - protein, 34 aa, Artificial Sequence; identical to SEQ ID NO: 2529
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2603 - protein, 34 aa, Artificial Sequence; identical to SEQ ID NO: 2529
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2604 - protein, 34 aa, Artificial Sequence; identical to SEQ ID NO: 2532
  Description of Artificial Sequence: Synthetic polypeptide
  MOD_RES (6)..(6): Nle
  MOD_RES (13)..(13): Pra
  C-term Amide

SEQ ID NO: 2605 - protein, 34 aa, Artificial Sequence; identical to SEQ ID NO: 2533
  Description of Artificial Sequence: Synthetic polypeptide
  MOD_RES (6)..(6): Nle
  MOD_RES (13)..(13): Pra
  C-term Amide

SEQ ID NO: 2606 - protein, 34 aa, Artificial Sequence; identical to SEQ ID NO: 2534
  Description of Artificial Sequence: Synthetic polypeptide
  MOD_RES (6)..(6): Nle
  MOD_RES (13)..(13): Pra
  C-term Amide

SEQ ID NO: 2607 - protein, 34 aa, Artificial Sequence; identical to SEQ ID NO: 2535
  Description of Artificial Sequence: Synthetic polypeptide
  MOD_RES (13)..(13): Pra
  C-term Amide

SEQ ID NO: 2608 - protein, 34 aa, Artificial Sequence; identical to SEQ ID NO: 2536
  Description of Artificial Sequence: Synthetic polypeptide
  MOD_RES (13)..(13): Pra
  C-term Amide

SEQ ID NO: 2609 - protein, 34 aa, Artificial Sequence; identical to SEQ ID NO: 2537
  Description of Artificial Sequence: Synthetic polypeptide
  MOD_RES (5)..(5): 2-Abu
  MOD_RES (13)..(13): Pra
  C-term Amide

SEQ ID NO: 2610 - protein, 34 aa, Artificial Sequence; identical to SEQ ID NO: 2537
  Description of Artificial Sequence: Synthetic polypeptide
  MOD_RES (5)..(5): Nva
  MOD_RES (13)..(13): Pra
  C-term Amide

SEQ ID NO: 2611 - protein, 34 aa, Artificial Sequence; identical to SEQ ID NO: 2537
  Description of Artificial Sequence: Synthetic polypeptide
  MOD_RES (5)..(5): Nle
  MOD_RES (13)..(13): Pra
  C-term Amide

SEQ ID NO: 2612 - protein, 34 aa, Artificial Sequence; identical to SEQ ID NO: 2540
  Description of Artificial Sequence: Synthetic polypeptide
  MOD_RES (13)..(13): Pra
  C-term Amide

SEQ ID NO: 2613 - protein, 34 aa, Artificial Sequence; identical to SEQ ID NO: 2541
  Description of Artificial Sequence: Synthetic polypeptide
  MOD_RES (13)..(13): Pra
  C-term Amide

SEQ ID NO: 2614 - protein, 34 aa, Artificial Sequence; identical to SEQ ID NO: 2542
  Description of Artificial Sequence: Synthetic polypeptide
  MOD_RES (13)..(13): Pra
  C-term Amide

SEQ ID NO: 2615 - protein, 34 aa, Artificial Sequence; identical to SEQ ID NO: 2543
  Description of Artificial Sequence: Synthetic polypeptide
  MOD_RES (13)..(13): Pra
  C-term Amide

SEQ ID NO: 2616 - protein, 34 aa, Artificial Sequence; identical to SEQ ID NO: 2544
  Description of Artificial Sequence: Synthetic polypeptide
  MOD_RES (13)..(13): Pra
  C-term Amide

SEQ ID NO: 2617 - protein, 34 aa, Artificial Sequence; identical to SEQ ID NO: 2545
  Description of Artificial Sequence: Synthetic polypeptide
  MOD_RES (5)..(5): 2-Abu
  MOD_RES (13)..(13): Pra
  C-term Amide

SEQ ID NO: 2618 - protein, 34 aa, Artificial Sequence; identical to SEQ ID NO: 2545
  Description of Artificial Sequence: Synthetic polypeptide
  MOD_RES (5)..(5): Nva
  MOD_RES (13)..(13): Pra
  C-term Amide

SEQ ID NO: 2619 - protein, 34 aa, Artificial Sequence; identical to SEQ ID NO: 2545
  Description of Artificial Sequence: Synthetic polypeptide
  MOD_RES (5)..(5): Nle
  MOD_RES (13)..(13): Pra
  C-term Amide

SEQ ID NO: 2620 - protein, 34 aa, Artificial Sequence; identical to SEQ ID NO: 2548
  Description of Artificial Sequence: Synthetic polypeptide
  MOD_RES (13)..(13): Pra
  C-term Amide

SEQ ID NO: 2621 - protein, 34 aa, Artificial Sequence; identical to SEQ ID NO: 2549
  Description of Artificial Sequence: Synthetic polypeptide
  MOD_RES (13)..(13): Pra
  C-term Amide

SEQ ID NO: 2622 - protein, 34 aa, Artificial Sequence; identical to SEQ ID NO: 2550
  Description of Artificial Sequence: Synthetic polypeptide
  MOD_RES (13)..(13): Pra
  C-term Amide

SEQ ID NO: 2623 - protein, 34 aa, Artificial Sequence; identical to SEQ ID NO: 2551
  Description of Artificial Sequence: Synthetic polypeptide
  MOD_RES (6)..(6): Nle
  MOD_RES (13)..(13): Pra
  C-term Amide

SEQ ID NO: 2624 - protein, 34 aa, Artificial Sequence; identical to SEQ ID NO: 2552
  Description of Artificial Sequence: Synthetic polypeptide
  MOD_RES (6)..(6): Nle
  MOD_RES (13)..(13): Pra
  C-term Amide

SEQ ID NO: 2625 - protein, 34 aa, Artificial Sequence; identical to SEQ ID NO: 2553
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2626 - protein, 34 aa, Artificial Sequence; identical to SEQ ID NO: 2553
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2627 - protein, 34 aa, Artificial Sequence; identical to SEQ ID NO: 2553
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2628 - protein, 34 aa, Artificial Sequence; identical to SEQ ID NO: 2556
  Description of Artificial Sequence: Synthetic polypeptide
  MOD_RES (6)..(6): Nle
  MOD_RES (13)..(13): Pra
  C-term Amide

SEQ ID NO: 2629 - protein, 34 aa, Artificial Sequence; identical to SEQ ID NO: 2557
  Description of Artificial Sequence: Synthetic polypeptide
  MOD_RES (6)..(6): Nle
  MOD_RES (13)..(13): Pra
  C-term Amide

SEQ ID NO: 2630 - protein, 34 aa, Artificial Sequence; identical to SEQ ID NO: 2558
  Description of Artificial Sequence: Synthetic polypeptide
  MOD_RES (6)..(6): Nle
  MOD_RES (13)..(13): Pra
  C-term Amide

SEQ ID NO: 2631 - protein, 34 aa, Artificial Sequence; identical to SEQ ID NO: 2559
  Description of Artificial Sequence: Synthetic polypeptide
  MOD_RES (13)..(13): Pra
  C-term Amide

SEQ ID NO: 2632 - protein, 34 aa, Artificial Sequence; identical to SEQ ID NO: 2560
  Description of Artificial Sequence: Synthetic polypeptide
  MOD_RES (13)..(13): Pra
  C-term Amide

SEQ ID NO: 2633 - protein, 34 aa, Artificial Sequence; identical to SEQ ID NO: 2561
  Description of Artificial Sequence: Synthetic polypeptide
  MOD_RES (5)..(5): 2-Abu
  MOD_RES (13)..(13): Pra
  C-term Amide

SEQ ID NO: 2634 - protein, 34 aa, Artificial Sequence; identical to SEQ ID NO: 2561
  Description of Artificial Sequence: Synthetic polypeptide
  MOD_RES (5)..(5): Nva
  MOD_RES (13)..(13): Pra
  C-term Amide

SEQ ID NO: 2635 - protein, 34 aa, Artificial Sequence; identical to SEQ ID NO: 2561
  Description of Artificial Sequence: Synthetic polypeptide
  MOD_RES (5)..(5): Nle
  MOD_RES (13)..(13): Pra
  C-term Amide

SEQ ID NO: 2636 - protein, 34 aa, Artificial Sequence; identical to SEQ ID NO: 2564
  Description of Artificial Sequence: Synthetic polypeptide
  MOD_RES (13)..(13): Pra
  C-term Amide

SEQ ID NO: 2637 - protein, 34 aa, Artificial Sequence; identical to SEQ ID NO: 2565
  Description of Artificial Sequence: Synthetic polypeptide
  MOD_RES (13)..(13): Pra
  C-term Amide

SEQ ID NO: 2638 - protein, 34 aa, Artificial Sequence; identical to SEQ ID NO: 2566
  Description of Artificial Sequence: Synthetic polypeptide
  MOD_RES (13)..(13): Pra
  C-term Amide

SEQ ID NO: 2639 - protein, 34 aa, Artificial Sequence; identical to SEQ ID NO: 2567
  Description of Artificial Sequence: Synthetic polypeptide
  MOD_RES (13)..(13): Pra
  C-term Amide

SEQ ID NO: 2640 - protein, 34 aa, Artificial Sequence; identical to SEQ ID NO: 2568
  Description of Artificial Sequence: Synthetic polypeptide
  MOD_RES (13)..(13): Pra
  C-term Amide

SEQ ID NO: 2641 - protein, 34 aa, Artificial Sequence; identical to SEQ ID NO: 2569
  Description of Artificial Sequence: Synthetic polypeptide
  MOD_RES (5)..(5): 2-Abu
  MOD_RES (13)..(13): Pra
  C-term Amide

SEQ ID NO: 2642 - protein, 34 aa, Artificial Sequence; identical to SEQ ID NO: 2569
  Description of Artificial Sequence: Synthetic polypeptide
  MOD_RES (5)..(5): Nva
  MOD_RES (13)..(13): Pra
  C-term Amide

SEQ ID NO: 2643 - protein, 34 aa, Artificial Sequence; identical to SEQ ID NO: 2569
  Description of Artificial Sequence: Synthetic polypeptide
  MOD_RES (5)..(5): Nle
  MOD_RES (13)..(13): Pra
  C-term Amide

SEQ ID NO: 2644 - protein, 34 aa, Artificial Sequence; identical to SEQ ID NO: 2572
  Description of Artificial Sequence: Synthetic polypeptide
  MOD_RES (13)..(13): Pra
  C-term Amide

SEQ ID NO: 2645 - protein, 34 aa, Artificial Sequence; identical to SEQ ID NO: 2573
  Description of Artificial Sequence: Synthetic polypeptide
  MOD_RES (13)..(13): Pra
  C-term Amide

SEQ ID NO: 2646 - protein, 34 aa, Artificial Sequence; identical to SEQ ID NO: 2574
  Description of Artificial Sequence: Synthetic polypeptide
  MOD_RES (13)..(13): Pra
  C-term Amide

SEQ ID NO: 2647 - protein, 34 aa, Artificial Sequence; identical to SEQ ID NO: 2575
  Description of Artificial Sequence: Synthetic polypeptide
  MOD_RES (6)..(6): Nle
  MOD_RES (13)..(13): Pra
  C-term Amide

SEQ ID NO: 2648 - protein, 34 aa, Artificial Sequence; identical to SEQ ID NO: 2576
  Description of Artificial Sequence: Synthetic polypeptide
  MOD_RES (6)..(6): Nle
  MOD_RES (13)..(13): Pra
  C-term Amide

SEQ ID NO: 2649 - protein, 34 aa, Artificial Sequence; identical to SEQ ID NO: 2577
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2650 - protein, 34 aa, Artificial Sequence; identical to SEQ ID NO: 2577
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2651 - protein, 34 aa, Artificial Sequence; identical to SEQ ID NO: 2577
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2652 - protein, 34 aa, Artificial Sequence; identical to SEQ ID NO: 2580
  Description of Artificial Sequence: Synthetic polypeptide
  MOD_RES (6)..(6): Nle
  MOD_RES (13)..(13): Pra
  C-term Amide

SEQ ID NO: 2653 - protein, 34 aa, Artificial Sequence; identical to SEQ ID NO: 2581
  Description of Artificial Sequence: Synthetic polypeptide
  MOD_RES (6)..(6): Nle
  MOD_RES (13)..(13): Pra
  C-term Amide

SEQ ID NO: 2654 - protein, 34 aa, Artificial Sequence; identical to SEQ ID NO: 2582
  Description of Artificial Sequence: Synthetic polypeptide
  MOD_RES (6)..(6): Nle
  MOD_RES (13)..(13): Pra
  C-term Amide

SEQ ID NO: 2655 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSRLHQWCKYVF

SEQ ID NO: 2656 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSRLHQWCKYVF

SEQ ID NO: 2657 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSRLHQWCKYVF

SEQ ID NO: 2658 - protein, 34 aa, Artificial Sequence; identical to SEQ ID NO: 2657
  Description of Artificial Sequence: Synthetic polypeptide
  MOD_RES (5)..(5): Nva
  MOD_RES (13)..(13): 2-Abu
  C-term Amide

SEQ ID NO: 2659 - protein, 34 aa, Artificial Sequence; identical to SEQ ID NO: 2657
  Description of Artificial Sequence: Synthetic polypeptide
  MOD_RES (5)..(5): Nle
  MOD_RES (13)..(13): 2-Abu
  C-term Amide

SEQ ID NO: 2660 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSRLHQWCKYVF

SEQ ID NO: 2661 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSRLHQWCKYVF

SEQ ID NO: 2662 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSRLHQWCKYVF

SEQ ID NO: 2663 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSRLHQWCKYVF

SEQ ID NO: 2664 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSRLHQWCKYVF

SEQ ID NO: 2665 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSRLHQWCKYVF

SEQ ID NO: 2666 - protein, 34 aa, Artificial Sequence; identical to SEQ ID NO: 2665
  Description of Artificial Sequence: Synthetic polypeptide
  MOD_RES (5)..(5): Nva
  MOD_RES (13)..(13): 2-Abu
  C-term Amide

SEQ ID NO: 2667 - protein, 34 aa, Artificial Sequence; identical to SEQ ID NO: 2665
  Description of Artificial Sequence: Synthetic polypeptide
  MOD_RES (5)..(5): Nle
  MOD_RES (13)..(13): 2-Abu
  C-term Amide

SEQ ID NO: 2668 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSRLHQWCKYVF

SEQ ID NO: 2669 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSRLHQWCKYVF

SEQ ID NO: 2670 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSRLHQWCKYVF

SEQ ID NO: 2671 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSRLHQWCKYVF

SEQ ID NO: 2672 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSRLHQWCKYVF

SEQ ID NO: 2673 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSRLHQWCKYVF

SEQ ID NO: 2674 - protein, 34 aa, Artificial Sequence; identical to SEQ ID NO: 2673
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2675 - protein, 34 aa, Artificial Sequence; identical to SEQ ID NO: 2673
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2676 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSRLHQWCKYVF

SEQ ID NO: 2677 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSRLHQWCKYVF

SEQ ID NO: 2678 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSRLHQWCKYVF

SEQ ID NO: 2679 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSRLHQWCKYVF

SEQ ID NO: 2680 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSRLHQWCKYVF

SEQ ID NO: 2681 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSRLHQWCKYVF

SEQ ID NO: 2682 - protein, 34 aa, Artificial Sequence; identical to SEQ ID NO: 2681
  Description of Artificial Sequence: Synthetic polypeptide
  MOD_RES (5)..(5): Nva
  MOD_RES (13)..(13): 2-Abu
  C-term Amide

SEQ ID NO: 2683 - protein, 34 aa, Artificial Sequence; identical to SEQ ID NO: 2681
  Description of Artificial Sequence: Synthetic polypeptide
  MOD_RES (5)..(5): Nle
  MOD_RES (13)..(13): 2-Abu
  C-term Amide

SEQ ID NO: 2684 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSRLHQWCKYVF

SEQ ID NO: 2685 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSRLHQWCKYVF

SEQ ID NO: 2686 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSRLHQWCKYVF

SEQ ID NO: 2687 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSRLHQWCKYVF

SEQ ID NO: 2688 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSRLHQWCKYVF

SEQ ID NO: 2689 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSRLHQWCKYVF

SEQ ID NO: 2690 - protein, 34 aa, Artificial Sequence; identical to SEQ ID NO: 2689
  Description of Artificial Sequence: Synthetic polypeptide
  MOD_RES (5)..(5): Nva
  MOD_RES (13)..(13): 2-Abu
  C-term Amide

SEQ ID NO: 2691 - protein, 34 aa, Artificial Sequence; identical to SEQ ID NO: 2689
  Description of Artificial Sequence: Synthetic polypeptide
  MOD_RES (5)..(5): Nle
  MOD_RES (13)..(13): 2-Abu
  C-term Amide

SEQ ID NO: 2692 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSRLHQWCKYVF

SEQ ID NO: 2693 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSRLHQWCKYVF

SEQ ID NO: 2694 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSRLHQWCKYVF

SEQ ID NO: 2695 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSRLHQWCKYVF

SEQ ID NO: 2696 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSRLHQWCKYVF

SEQ ID NO: 2697 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSRLHQWCKYVF

SEQ ID NO: 2698 - protein, 34 aa, Artificial Sequence; identical to SEQ ID NO: 2697
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2699 - protein, 34 aa, Artificial Sequence; identical to SEQ ID NO: 2697
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2700 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSRLHQWCKYVF

SEQ ID NO: 2701 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSRLHQWCKYVF

SEQ ID NO: 2702 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSRLHQWCKYVF

SEQ ID NO: 2703 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSRLHQWCKYVF

SEQ ID NO: 2704 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSRLHQWCKYVF

SEQ ID NO: 2705 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSRLHQWCKYVF

SEQ ID NO: 2706 - protein, 34 aa, Artificial Sequence; identical to SEQ ID NO: 2705
  Description of Artificial Sequence: Synthetic polypeptide
  MOD_RES (5)..(5): Nva
  MOD_RES (13)..(13): 2-Abu
  C-term Amide

SEQ ID NO: 2707 - protein, 34 aa, Artificial Sequence; identical to SEQ ID NO: 2705
  Description of Artificial Sequence: Synthetic polypeptide
  MOD_RES (5)..(5): Nle
  MOD_RES (13)..(13): 2-Abu
  C-term Amide

SEQ ID NO: 2708 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSRLHQWCKYVF

SEQ ID NO: 2709 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSRLHQWCKYVF

SEQ ID NO: 2710 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSRLHQWCKYVF

SEQ ID NO: 2711 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSRLHQWCKYVF

SEQ ID NO: 2712 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSRLHQWCKYVF

SEQ ID NO: 2713 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSRLHQWCKYVF

SEQ ID NO: 2714 - protein, 34 aa, Artificial Sequence; identical to SEQ ID NO: 2713
  Description of Artificial Sequence: Synthetic polypeptide
  MOD_RES (5)..(5): Nva
  MOD_RES (13)..(13): 2-Abu
  C-term Amide

SEQ ID NO: 2715 - protein, 34 aa, Artificial Sequence; identical to SEQ ID NO: 2713
  Description of Artificial Sequence: Synthetic polypeptide
  MOD_RES (5)..(5): Nle
  MOD_RES (13)..(13): 2-Abu
  C-term Amide

SEQ ID NO: 2716 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSRLHQWCKYVF

SEQ ID NO: 2717 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSRLHQWCKYVF

SEQ ID NO: 2718 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSRLHQWCKYVF

SEQ ID NO: 2719 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSRLHQWCKYVF

SEQ ID NO: 2720 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSRLHQWCKYVF

SEQ ID NO: 2721 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSRLHQWCKYVF

SEQ ID NO: 2722 - protein, 34 aa, Artificial Sequence; identical to SEQ ID NO: 2721
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2723 - protein, 34 aa, Artificial Sequence; identical to SEQ ID NO: 2721
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2724 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSRLHQWCKYVF

SEQ ID NO: 2725 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSRLHQWCKYVF

SEQ ID NO: 2726 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSRLHQWCKYVF

SEQ ID NO: 2727 - protein, 34 aa, Artificial Sequence; identical to SEQ ID NO: 2655
  Description of Artificial Sequence: Synthetic polypeptide
  MOD_RES (13)..(13): Pra
  C-term Amide

SEQ ID NO: 2728 - protein, 34 aa, Artificial Sequence; identical to SEQ ID NO: 2656
  Description of Artificial Sequence: Synthetic polypeptide
  MOD_RES (13)..(13): Pra
  C-term Amide

SEQ ID NO: 2729 - protein, 34 aa, Artificial Sequence; identical to SEQ ID NO: 2657
  Description of Artificial Sequence: Synthetic polypeptide
  MOD_RES (5)..(5): 2-Abu
  MOD_RES (13)..(13): Pra
  C-term Amide

SEQ ID NO: 2730 - protein, 34 aa, Artificial Sequence; identical to SEQ ID NO: 2657
  Description of Artificial Sequence: Synthetic polypeptide
  MOD_RES (5)..(5): Nva
  MOD_RES (13)..(13): Pra
  C-term Amide

SEQ ID NO: 2731 - protein, 34 aa, Artificial Sequence; identical to SEQ ID NO: 2657
  Description of Artificial Sequence: Synthetic polypeptide
  MOD_RES (5)..(5): Nle
  MOD_RES (13)..(13): Pra
  C-term Amide

SEQ ID NO: 2732 - protein, 34 aa, Artificial Sequence; identical to SEQ ID NO: 2660
  Description of Artificial Sequence: Synthetic polypeptide
  MOD_RES (13)..(13): Pra
  C-term Amide

SEQ ID NO: 2733 - protein, 34 aa, Artificial Sequence; identical to SEQ ID NO: 2661
  Description of Artificial Sequence: Synthetic polypeptide
  MOD_RES (13)..(13): Pra
  C-term Amide

SEQ ID NO: 2734 - protein, 34 aa, Artificial Sequence; identical to SEQ ID NO: 2662
  Description of Artificial Sequence: Synthetic polypeptide
  MOD_RES (13)..(13): Pra
  C-term Amide

SEQ ID NO: 2735 - protein, 34 aa, Artificial Sequence; identical to SEQ ID NO: 2663
  Description of Artificial Sequence: Synthetic polypeptide
  MOD_RES (13)..(13): Pra
  C-term Amide

SEQ ID NO: 2736 - protein, 34 aa, Artificial Sequence; identical to SEQ ID NO: 2664
  Description of Artificial Sequence: Synthetic polypeptide
  MOD_RES (13)..(13): Pra
  C-term Amide

SEQ ID NO: 2737 - protein, 34 aa, Artificial Sequence; identical to SEQ ID NO: 2665
  Description of Artificial Sequence: Synthetic polypeptide
  MOD_RES (5)..(5): 2-Abu
  MOD_RES (13)..(13): Pra
  C-term Amide

SEQ ID NO: 2738 - protein, 34 aa, Artificial Sequence; identical to SEQ ID NO: 2665
  Description of Artificial Sequence: Synthetic polypeptide
  MOD_RES (5)..(5): Nva
  MOD_RES (13)..(13): Pra
  C-term Amide

SEQ ID NO: 2739 - protein, 34 aa, Artificial Sequence; identical to SEQ ID NO: 2665
  Description of Artificial Sequence: Synthetic polypeptide
  MOD_RES (5)..(5): Nle
  MOD_RES (13)..(13): Pra
  C-term Amide

SEQ ID NO: 2740 - protein, 34 aa, Artificial Sequence; identical to SEQ ID NO: 2668
  Description of Artificial Sequence: Synthetic polypeptide
  MOD_RES (13)..(13): Pra
  C-term Amide

SEQ ID NO: 2741 - protein, 34 aa, Artificial Sequence; identical to SEQ ID NO: 2669
  Description of Artificial Sequence: Synthetic polypeptide
  MOD_RES (13)..(13): Pra
  C-term Amide

SEQ ID NO: 2742 - protein, 34 aa, Artificial Sequence; identical to SEQ ID NO: 2670
  Description of Artificial Sequence: Synthetic polypeptide
  MOD_RES (13)..(13): Pra
  C-term Amide

SEQ ID NO: 2743 - protein, 34 aa, Artificial Sequence; identical to SEQ ID NO: 2671
  Description of Artificial Sequence: Synthetic polypeptide
  MOD_RES (6)..(6): Nle
  MOD_RES (13)..(13): Pra
  C-term Amide

SEQ ID NO: 2744 - protein, 34 aa, Artificial Sequence; identical to SEQ ID NO: 2672
  Description of Artificial Sequence: Synthetic polypeptide
  MOD_RES (6)..(6): Nle
  MOD_RES (13)..(13): Pra
  C-term Amide

SEQ ID NO: 2745 - protein, 34 aa, Artificial Sequence; identical to SEQ ID NO: 2673
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2746 - protein, 34 aa, Artificial Sequence; identical to SEQ ID NO: 2673
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2747 - protein, 34 aa, Artificial Sequence; identical to SEQ ID NO: 2673
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2748 - protein, 34 aa, Artificial Sequence; identical to SEQ ID NO: 2676
  Description of Artificial Sequence: Synthetic polypeptide
  MOD_RES (6)..(6): Nle
  MOD_RES (13)..(13): Pra
  C-term Amide

SEQ ID NO: 2749 - protein, 34 aa, Artificial Sequence; identical to SEQ ID NO: 2677
  Description of Artificial Sequence: Synthetic polypeptide
  MOD_RES (6)..(6): Nle
  MOD_RES (13)..(13): Pra
  C-term Amide

SEQ ID NO: 2750 - protein, 34 aa, Artificial Sequence; identical to SEQ ID NO: 2678
  Description of Artificial Sequence: Synthetic polypeptide
  MOD_RES (6)..(6): Nle
  MOD_RES (13)..(13): Pra
  C-term Amide

SEQ ID NO: 2751 - protein, 34 aa, Artificial Sequence; identical to SEQ ID NO: 2679
  Description of Artificial Sequence: Synthetic polypeptide
  MOD_RES (13)..(13): Pra
  C-term Amide

SEQ ID NO: 2752 - protein, 34 aa, Artificial Sequence; identical to SEQ ID NO: 2680
  Description of Artificial Sequence: Synthetic polypeptide
  MOD_RES (13)..(13): Pra
  C-term Amide

SEQ ID NO: 2753 - protein, 34 aa, Artificial Sequence; identical to SEQ ID NO: 2681
  Description of Artificial Sequence: Synthetic polypeptide
  MOD_RES (5)..(5): 2-Abu
  MOD_RES (13)..(13): Pra
  C-term Amide

SEQ ID NO: 2754 - protein, 34 aa, Artificial Sequence; identical to SEQ ID NO: 2681
  Description of Artificial Sequence: Synthetic polypeptide
  MOD_RES (5)..(5): Nva
  MOD_RES (13)..(13): Pra
  C-term Amide

SEQ ID NO: 2755 - protein, 34 aa, Artificial Sequence; identical to SEQ ID NO: 2681
  Description of Artificial Sequence: Synthetic polypeptide
  MOD_RES (5)..(5): Nle
  MOD_RES (13)..(13): Pra
  C-term Amide

SEQ ID NO: 2756 - protein, 34 aa, Artificial Sequence; identical to SEQ ID NO: 2684
  Description of Artificial Sequence: Synthetic polypeptide
  MOD_RES (13)..(13): Pra
  C-term Amide

SEQ ID NO: 2757 - protein, 34 aa, Artificial Sequence; identical to SEQ ID NO: 2685
  Description of Artificial Sequence: Synthetic polypeptide
  MOD_RES (13)..(13): Pra
  C-term Amide

SEQ ID NO: 2758 - protein, 34 aa, Artificial Sequence; identical to SEQ ID NO: 2686
  Description of Artificial Sequence: Synthetic polypeptide
  MOD_RES (13)..(13): Pra
  C-term Amide

SEQ ID NO: 2759 - protein, 34 aa, Artificial Sequence; identical to SEQ ID NO: 2687
  Description of Artificial Sequence: Synthetic polypeptide
  MOD_RES (13)..(13): Pra
  C-term Amide

SEQ ID NO: 2760 - protein, 34 aa, Artificial Sequence; identical to SEQ ID NO: 2688
  Description of Artificial Sequence: Synthetic polypeptide
  MOD_RES (13)..(13): Pra
  C-term Amide

SEQ ID NO: 2761 - protein, 34 aa, Artificial Sequence; identical to SEQ ID NO: 2689
  Description of Artificial Sequence: Synthetic polypeptide
  MOD_RES (5)..(5): 2-Abu
  MOD_RES (13)..(13): Pra
  C-term Amide

SEQ ID NO: 2762 - protein, 34 aa, Artificial Sequence; identical to SEQ ID NO: 2689
  Description of Artificial Sequence: Synthetic polypeptide
  MOD_RES (5)..(5): Nva
  MOD_RES (13)..(13): Pra
  C-term Amide

SEQ ID NO: 2763 - protein, 34 aa, Artificial Sequence; identical to SEQ ID NO: 2689
  Description of Artificial Sequence: Synthetic polypeptide
  MOD_RES (5)..(5): Nle
  MOD_RES (13)..(13): Pra
  C-term Amide

SEQ ID NO: 2764 - protein, 34 aa, Artificial Sequence; identical to SEQ ID NO: 2692
  Description of Artificial Sequence: Synthetic polypeptide
  MOD_RES (13)..(13): Pra
  C-term Amide

SEQ ID NO: 2765 - protein, 34 aa, Artificial Sequence; identical to SEQ ID NO: 2693
  Description of Artificial Sequence: Synthetic polypeptide
  MOD_RES (13)..(13): Pra
  C-term Amide

SEQ ID NO: 2766 - protein, 34 aa, Artificial Sequence; identical to SEQ ID NO: 2694
  Description of Artificial Sequence: Synthetic polypeptide
  MOD_RES (13)..(13): Pra
  C-term Amide

SEQ ID NO: 2767 - protein, 34 aa, Artificial Sequence; identical to SEQ ID NO: 2695
  Description of Artificial Sequence: Synthetic polypeptide
  MOD_RES (6)..(6): Nle
  MOD_RES (13)..(13): Pra
  C-term Amide

SEQ ID NO: 2768 - protein, 34 aa, Artificial Sequence; identical to SEQ ID NO: 2696
  Description of Artificial Sequence: Synthetic polypeptide
  MOD_RES (6)..(6): Nle
  MOD_RES (13)..(13): Pra
  C-term Amide

SEQ ID NO: 2769 - protein, 34 aa, Artificial Sequence; identical to SEQ ID NO: 2697
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2770 - protein, 34 aa, Artificial Sequence; identical to SEQ ID NO: 2697
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2771 - protein, 34 aa, Artificial Sequence; identical to SEQ ID NO: 2697
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2772 - protein, 34 aa, Artificial Sequence; identical to SEQ ID NO: 2700
  Description of Artificial Sequence: Synthetic polypeptide
  MOD_RES (6)..(6): Nle
  MOD_RES (13)..(13): Pra
  C-term Amide

SEQ ID NO: 2773 - protein, 34 aa, Artificial Sequence; identical to SEQ ID NO: 2701
  Description of Artificial Sequence: Synthetic polypeptide
  MOD_RES (6)..(6): Nle
  MOD_RES (13)..(13): Pra
  C-term Amide

SEQ ID NO: 2774 - protein, 34 aa, Artificial Sequence; identical to SEQ ID NO: 2702
  Description of Artificial Sequence: Synthetic polypeptide
  MOD_RES (6)..(6): Nle
  MOD_RES (13)..(13): Pra
  C-term Amide

SEQ ID NO: 2775 - protein, 34 aa, Artificial Sequence; identical to SEQ ID NO: 2703
  Description of Artificial Sequence: Synthetic polypeptide
  MOD_RES (13)..(13): Pra
  C-term Amide

SEQ ID NO: 2776 - protein, 34 aa, Artificial Sequence; identical to SEQ ID NO: 2704
  Description of Artificial Sequence: Synthetic polypeptide
  MOD_RES (13)..(13): Pra
  C-term Amide

SEQ ID NO: 2777 - protein, 34 aa, Artificial Sequence; identical to SEQ ID NO: 2705
  Description of Artificial Sequence: Synthetic polypeptide
  MOD_RES (5)..(5): 2-Abu
  MOD_RES (13)..(13): Pra
  C-term Amide

SEQ ID NO: 2778 - protein, 34 aa, Artificial Sequence; identical to SEQ ID NO: 2705
  Description of Artificial Sequence: Synthetic polypeptide
  MOD_RES (5)..(5): Nva
  MOD_RES (13)..(13): Pra
  C-term Amide

SEQ ID NO: 2779 - protein, 34 aa, Artificial Sequence; identical to SEQ ID NO: 2705
  Description of Artificial Sequence: Synthetic polypeptide
  MOD_RES (5)..(5): Nle
  MOD_RES (13)..(13): Pra
  C-term Amide

SEQ ID NO: 2780 - protein, 34 aa, Artificial Sequence; identical to SEQ ID NO: 2708
  Description of Artificial Sequence: Synthetic polypeptide
  MOD_RES (13)..(13): Pra
  C-term Amide

SEQ ID NO: 2781 - protein, 34 aa, Artificial Sequence; identical to SEQ ID NO: 2709
  Description of Artificial Sequence: Synthetic polypeptide
  MOD_RES (13)..(13): Pra
  C-term Amide

SEQ ID NO: 2782 - protein, 34 aa, Artificial Sequence; identical to SEQ ID NO: 2710
  Description of Artificial Sequence: Synthetic polypeptide
  MOD_RES (13)..(13): Pra
  C-term Amide

SEQ ID NO: 2783 - protein, 34 aa, Artificial Sequence; identical to SEQ ID NO: 2711
  Description of Artificial Sequence: Synthetic polypeptide
  MOD_RES (13)..(13): Pra
  C-term Amide

SEQ ID NO: 2784 - protein, 34 aa, Artificial Sequence; identical to SEQ ID NO: 2712
  Description of Artificial Sequence: Synthetic polypeptide
  MOD_RES (13)..(13): Pra
  C-term Amide

SEQ ID NO: 2785 - protein, 34 aa, Artificial Sequence; identical to SEQ ID NO: 2713
  Description of Artificial Sequence: Synthetic polypeptide
  MOD_RES (5)..(5): 2-Abu
  MOD_RES (13)..(13): Pra
  C-term Amide

SEQ ID NO: 2786 - protein, 34 aa, Artificial Sequence; identical to SEQ ID NO: 2713
  Description of Artificial Sequence: Synthetic polypeptide
  MOD_RES (5)..(5): Nva
  MOD_RES (13)..(13): Pra
  C-term Amide

SEQ ID NO: 2787 - protein, 34 aa, Artificial Sequence; identical to SEQ ID NO: 2713
  Description of Artificial Sequence: Synthetic polypeptide
  MOD_RES (5)..(5): Nle
  MOD_RES (13)..(13): Pra
  C-term Amide

SEQ ID NO: 2788 - protein, 34 aa, Artificial Sequence; identical to SEQ ID NO: 2716
  Description of Artificial Sequence: Synthetic polypeptide
  MOD_RES (13)..(13): Pra
  C-term Amide

SEQ ID NO: 2789 - protein, 34 aa, Artificial Sequence; identical to SEQ ID NO: 2717
  Description of Artificial Sequence: Synthetic polypeptide
  MOD_RES (13)..(13): Pra
  C-term Amide

SEQ ID NO: 2790 - protein, 34 aa, Artificial Sequence; identical to SEQ ID NO: 2718
  Description of Artificial Sequence: Synthetic polypeptide
  MOD_RES (13)..(13): Pra
  C-term Amide

SEQ ID NO: 2791 - protein, 34 aa, Artificial Sequence; identical to SEQ ID NO: 2719
  Description of Artificial Sequence: Synthetic polypeptide
  MOD_RES (6)..(6): Nle
  MOD_RES (13)..(13): Pra
  C-term Amide

SEQ ID NO: 2792 - protein, 34 aa, Artificial Sequence; identical to SEQ ID NO: 2720
  Description of Artificial Sequence: Synthetic polypeptide
  MOD_RES (6)..(6): Nle
  MOD_RES (13)..(13): Pra
  C-term Amide

SEQ ID NO: 2793 - protein, 34 aa, Artificial Sequence; identical to SEQ ID NO: 2721
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2794 - protein, 34 aa, Artificial Sequence; identical to SEQ ID NO: 2721
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2795 - protein, 34 aa, Artificial Sequence; identical to SEQ ID NO: 2721
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2796 - protein, 34 aa, Artificial Sequence; identical to SEQ ID NO: 2724
  Description of Artificial Sequence: Synthetic polypeptide
  MOD_RES (6)..(6): Nle
  MOD_RES (13)..(13): Pra
  C-term Amide

SEQ ID NO: 2797 - protein, 34 aa, Artificial Sequence; identical to SEQ ID NO: 2725
  Description of Artificial Sequence: Synthetic polypeptide
  MOD_RES (6)..(6): Nle
  MOD_RES (13)..(13): Pra
  C-term Amide

SEQ ID NO: 2798 - protein, 34 aa, Artificial Sequence; identical to SEQ ID NO: 2726
  Description of Artificial Sequence: Synthetic polypeptide
  MOD_RES (6)..(6): Nle
  MOD_RES (13)..(13): Pra
  C-term Amide

SEQ ID NO: 2799 - protein, 34 aa, Artificial Sequence
  Description of Artificial Sequence: Synthetic polypeptide
  MOD_RES (13)..(13): 2-Abu
  C-term Amide
DCLGFMRKCIPDXDKCCRPNLVCSREHKWCKYVF

SEQ ID NO: 2800 - protein, 34 aa, Artificial Sequence; identical to SEQ ID NO: 2799
  Description of Artificial Sequence: Synthetic polypeptide
  MOD_RES (13)..(13): Pra
  C-term Amide

SEQ ID NO: 2801 - protein, 34 aa, Artificial Sequence
  Description of Artificial Sequence: Synthetic polypeptide
  MOD_RES (13)..(13): 2-Abu
  C-term Amide
DCLGFMRKCIEDXDKCCRPNLVCSREHKWCKYVF

SEQ ID NO: 2802 - protein, 34 aa, Artificial Sequence
  Description of Artificial Sequence: Synthetic polypeptide
  MOD_RES (13)..(13): 2-Abu
  C-term Amide
DCLGFMRKCEPDXDKCCRPNLVCSREHKWCKYVF

SEQ ID NO: 2803 - protein, 34 aa, Artificial Sequence
  Description of Artificial Sequence: Synthetic polypeptide
  MOD_RES (13)..(13): 2-Abu
  C-term Amide
DCLGFMRKCDPDXDKCCRPNLVCSREHKWCKYVF

SEQ ID NO: 2804 - protein, 34 aa, Artificial Sequence
  Description of Artificial Sequence: Synthetic polypeptide
  MOD_RES (13)..(13): 2-Abu
  C-term Amide
DCLGFFRKCIPDXDKCCRPNLVCSREHKWCKYVF

SEQ ID NO: 2805 - protein, 34 aa, Artificial Sequence
  Description of Artificial Sequence: Synthetic polypeptide
  MOD_RES (13)..(13): 2-Abu
  C-term Amide
DCLGFLRKCIPDXDKCCRPNLVCSREHKWCKYVF

SEQ ID NO: 2806 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIPDXDKCCRPNLVCSREHKWCKYVF

SEQ ID NO: 2807 - protein, 34 aa, Artificial Sequence
  Description of Artificial Sequence: Synthetic polypeptide
  MOD_RES (13)..(13): 2-Abu
  C-term Amide
DCLGGMRKCIPDXDKCCRPNLVCSREHKWCKYVF

SEQ ID NO: 2808 - protein, 34 aa, Artificial Sequence
  Description of Artificial Sequence: Synthetic polypeptide
  MOD_RES (13)..(13): 2-Abu
  C-term Amide
DCLGAMRKCIPDXDKCCRPNLVCSREHKWCKYVF

SEQ ID NO: 2809 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIPDXDKCCRPNLVCSREHKWCKYVF

SEQ ID NO: 2810 - protein, 34 aa, Artificial Sequence; identical to SEQ ID NO: 2809
  Description of Artificial Sequence: Synthetic polypeptide
  MOD_RES (5)..(5): Nva
  MOD_RES (13)..(13): 2-Abu
  C-term Amide

SEQ ID NO: 2811 - protein, 34 aa, Artificial Sequence; identical to SEQ ID NO: 2809
  Description of Artificial Sequence: Synthetic polypeptide
  MOD_RES (5)..(5): Nle
  MOD_RES (13)..(13): 2-Abu
  C-term Amide

SEQ ID NO: 2812 - protein, 34 aa, Artificial Sequence
  Description of Artificial Sequence: Synthetic polypeptide
  MOD_RES (13)..(13): 2-Abu
  C-term Amide
DCLGVMRKCIPDXDKCCRPNLVCSREHKWCKYVF

SEQ ID NO: 2813 - protein, 34 aa, Artificial Sequence
  Description of Artificial Sequence: Synthetic polypeptide
  MOD_RES (13)..(13): 2-Abu
  C-term Amide
DCLGLMRKCIPDXDKCCRPNLVCSREHKWCKYVF

SEQ ID NO: 2814 - protein, 34 aa, Artificial Sequence
  Description of Artificial Sequence: Synthetic polypeptide
  MOD_RES (13)..(13): 2-Abu
  C-term Amide
DCLGIMRKCIPDXDKCCRPNLVCSREHKWCKYVF

SEQ ID NO: 2815 - protein, 34 aa, Artificial Sequence; identical to SEQ ID NO: 2801
  Description of Artificial Sequence: Synthetic polypeptide
  MOD_RES (13)..(13): Pra
  C-term Amide

SEQ ID NO: 2816 - protein, 34 aa, Artificial Sequence; identical to SEQ ID NO: 2802
  Description of Artificial Sequence: Synthetic polypeptide
  MOD_RES (13)..(13): Pra
  C-term Amide

SEQ ID NO: 2817 - protein, 34 aa, Artificial Sequence; identical to SEQ ID NO: 2803
  Description of Artificial Sequence: Synthetic polypeptide
  MOD_RES (13)..(13): Pra
  C-term Amide

SEQ ID NO: 2818 - protein, 34 aa, Artificial Sequence; identical to SEQ ID NO: 2804
  Description of Artificial Sequence: Synthetic polypeptide
  MOD_RES (13)..(13): Pra
  C-term Amide

SEQ ID NO: 2819 - protein, 34 aa, Artificial Sequence; identical to SEQ ID NO: 2805
  Description of Artificial Sequence: Synthetic polypeptide
  MOD_RES (13)..(13): Pra
  C-term Amide

SEQ ID NO: 2820 - protein, 34 aa, Artificial Sequence; identical to SEQ ID NO: 2806
  Description of Artificial Sequence: Synthetic polypeptide
  MOD_RES (6)..(6): Nle
  MOD_RES (13)..(13): Pra
  C-term Amide

SEQ ID NO: 2821 - protein, 34 aa, Artificial Sequence; identical to SEQ ID NO: 2807
  Description of Artificial Sequence: Synthetic polypeptide
  MOD_RES (13)..(13): Pra
  C-term Amide

SEQ ID NO: 2822 - protein, 34 aa, Artificial Sequence; identical to SEQ ID NO: 2808
  Description of Artificial Sequence: Synthetic polypeptide
  MOD_RES (13)..(13): Pra
  C-term Amide

SEQ ID NO: 2823 - protein, 34 aa, Artificial Sequence; identical to SEQ ID NO: 2809
  Description of Artificial Sequence: Synthetic polypeptide
  MOD_RES (5)..(5): 2-Abu
  MOD_RES (13)..(13): Pra
  C-term Amide

SEQ ID NO: 2824 - protein, 34 aa, Artificial Sequence; identical to SEQ ID NO: 2809
  Description of Artificial Sequence: Synthetic polypeptide
  MOD_RES (5)..(5): Nva
  MOD_RES (13)..(13): Pra
  C-term Amide

SEQ ID NO: 2825 - protein, 34 aa, Artificial Sequence; identical to SEQ ID NO: 2809
  Description of Artificial Sequence: Synthetic polypeptide
  MOD_RES (5)..(5): Nle
  MOD_RES (13)..(13): Pra
  C-term Amide

SEQ ID NO: 2826 - protein, 34 aa, Artificial Sequence; identical to SEQ ID NO: 2812
  Description of Artificial Sequence: Synthetic polypeptide
  MOD_RES (13)..(13): Pra
  C-term Amide

SEQ ID NO: 2827 - protein, 34 aa, Artificial Sequence; identical to SEQ ID NO: 2813
  Description of Artificial Sequence: Synthetic polypeptide
  MOD_RES (13)..(13): Pra
  C-term Amide

SEQ ID NO: 2828 - protein, 34 aa, Artificial Sequence; identical to SEQ ID NO: 2814
  Description of Artificial Sequence: Synthetic polypeptide
  MOD_RES (13)..(13): Pra
  C-term Amide

SEQ ID NO: 2829 - protein, 34 aa, Artificial Sequence
  Description of Artificial Sequence: Synthetic polypeptide
  MOD_RES (13)..(13): 2-Abu
  C-term Amide
DCLGFFRKCIEDXDKCCRPNLVCSREHKWCKYVF

SEQ ID NO: 2830 - protein, 34 aa, Artificial Sequence
  Description of Artificial Sequence: Synthetic polypeptide
  MOD_RES (13)..(13): 2-Abu
  C-term Amide
DCLGFLRKCIEDXDKCCRPNLVCSREHKWCKYVF

SEQ ID NO: 2831 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCIEDXDKCCRPNLVCSREHKWCKYVF

SEQ ID NO: 2832 - protein, 34 aa, Artificial Sequence
  Description of Artificial Sequence: Synthetic polypeptide
  MOD_RES (13)..(13): 2-Abu
  C-term Amide
DCLGGMRKCIEDXDKCCRPNLVCSREHKWCKYVF

SEQ ID NO: 2833 - protein, 34 aa, Artificial Sequence
  Description of Artificial Sequence: Synthetic polypeptide
  MOD_RES (13)..(13): 2-Abu
  C-term Amide
DCLGAMRKCIEDXDKCCRPNLVCSREHKWCKYVF

SEQ ID NO: 2834 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCIEDXDKCCRPNLVCSREHKWCKYVF

SEQ ID NO: 2835 - protein, 34 aa, Artificial Sequence; identical to SEQ ID NO: 2834
  Description of Artificial Sequence: Synthetic polypeptide
  MOD_RES (5)..(5): Nva
  MOD_RES (13)..(13): 2-Abu
  C-term Amide

SEQ ID NO: 2836 - protein, 34 aa, Artificial Sequence; identical to SEQ ID NO: 2834
  Description of Artificial Sequence: Synthetic polypeptide
  MOD_RES (5)..(5): Nle
  MOD_RES (13)..(13): 2-Abu
  C-term Amide

SEQ ID NO: 2837 - protein, 34 aa, Artificial Sequence
  Description of Artificial Sequence: Synthetic polypeptide
  MOD_RES (13)..(13): 2-Abu
  C-term Amide
DCLGVMRKCIEDXDKCCRPNLVCSREHKWCKYVF

SEQ ID NO: 2838 - protein, 34 aa, Artificial Sequence
  Description of Artificial Sequence: Synthetic polypeptide
  MOD_RES (13)..(13): 2-Abu
  C-term Amide
DCLGLMRKCIEDXDKCCRPNLVCSREHKWCKYVF

SEQ ID NO: 2839 - protein, 34 aa, Artificial Sequence
  Description of Artificial Sequence: Synthetic polypeptide
  MOD_RES (13)..(13): 2-Abu
  C-term Amide
DCLGIMRKCIEDXDKCCRPNLVCSREHKWCKYVF

SEQ ID NO: 2840 - protein, 34 aa, Artificial Sequence
  Description of Artificial Sequence: Synthetic polypeptide
  MOD_RES (13)..(13): 2-Abu
  C-term Amide
DCLGFFRKCEPDXDKCCRPNLVCSREHKWCKYVF

SEQ ID NO: 2841 - protein, 34 aa, Artificial Sequence
  Description of Artificial Sequence: Synthetic polypeptide
  MOD_RES (13)..(13): 2-Abu
  C-term Amide
DCLGFLRKCEPDXDKCCRPNLVCSREHKWCKYVF

SEQ ID NO: 2842 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCEPDXDKCCRPNLVCSREHKWCKYVF

SEQ ID NO: 2843 - protein, 34 aa, Artificial Sequence
  Description of Artificial Sequence: Synthetic polypeptide
  MOD_RES (13)..(13): 2-Abu
  C-term Amide
DCLGGMRKCEPDXDKCCRPNLVCSREHKWCKYVF

SEQ ID NO: 2844 - protein, 34 aa, Artificial Sequence
  Description of Artificial Sequence: Synthetic polypeptide
  MOD_RES (13)..(13): 2-Abu
  C-term Amide
DCLGAMRKCEPDXDKCCRPNLVCSREHKWCKYVF

SEQ ID NO: 2845 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCEPDXDKCCRPNLVCSREHKWCKYVF

SEQ ID NO: 2846 - protein, 34 aa, Artificial Sequence; identical to SEQ ID NO: 2845
  Description of Artificial Sequence: Synthetic polypeptide
  MOD_RES (5)..(5): Nva
  MOD_RES (13)..(13): 2-Abu
  C-term Amide

SEQ ID NO: 2847 - protein, 34 aa, Artificial Sequence; identical to SEQ ID NO: 2845
  Description of Artificial Sequence: Synthetic polypeptide
  MOD_RES (5)..(5): Nle
  MOD_RES (13)..(13): 2-Abu
  C-term Amide

SEQ ID NO: 2848 - protein, 34 aa, Artificial Sequence
  Description of Artificial Sequence: Synthetic polypeptide
  MOD_RES (13)..(13): 2-Abu
  C-term Amide
DCLGVMRKCEPDXDKCCRPNLVCSREHKWCKYVF

SEQ ID NO: 2849 - protein, 34 aa, Artificial Sequence
  Description of Artificial Sequence: Synthetic polypeptide
  MOD_RES (13)..(13): 2-Abu
  C-term Amide
DCLGLMRKCEPDXDKCCRPNLVCSREHKWCKYVF

SEQ ID NO: 2850 - protein, 34 aa, Artificial Sequence
  Description of Artificial Sequence: Synthetic polypeptide
  MOD_RES (13)..(13): 2-Abu
  C-term Amide
DCLGIMRKCEPDXDKCCRPNLVCSREHKWCKYVF

SEQ ID NO: 2851 - protein, 34 aa, Artificial Sequence
  Description of Artificial Sequence: Synthetic polypeptide
  MOD_RES (13)..(13): 2-Abu
  C-term Amide
DCLGFFRKCDPDXDKCCRPNLVCSREHKWCKYVF

SEQ ID NO: 2852 - protein, 34 aa, Artificial Sequence
  Description of Artificial Sequence: Synthetic polypeptide
  MOD_RES (13)..(13): 2-Abu
  C-term Amide
DCLGFLRKCDPDXDKCCRPNLVCSREHKWCKYVF

SEQ ID NO: 2853 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGFXRKCDPDXDKCCRPNLVCSREHKWCKYVF

SEQ ID NO: 2854 - protein, 34 aa, Artificial Sequence
  Description of Artificial Sequence: Synthetic polypeptide
  MOD_RES (13)..(13): 2-Abu
  C-term Amide
DCLGGMRKCDPDXDKCCRPNLVCSREHKWCKYVF

SEQ ID NO: 2855 - protein, 34 aa, Artificial Sequence
  Description of Artificial Sequence: Synthetic polypeptide
  MOD_RES (13)..(13): 2-Abu
  C-term Amide
DCLGAMRKCDPDXDKCCRPNLVCSREHKWCKYVF

SEQ ID NO: 2856 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXMRKCDPDXDKCCRPNLVCSREHKWCKYVF

SEQ ID NO: 2857 - protein, 34 aa, Artificial Sequence; identical to SEQ ID NO: 2856
  Description of Artificial Sequence: Synthetic polypeptide
  MOD_RES (5)..(5): Nva
  MOD_RES (13)..(13): 2-Abu
  C-term Amide

SEQ ID NO: 2858 - protein, 34 aa, Artificial Sequence; identical to SEQ ID NO: 2856
  Description of Artificial Sequence: Synthetic polypeptide
  MOD_RES (5)..(5): Nle
  MOD_RES (13)..(13): 2-Abu
  C-term Amide

SEQ ID NO: 2859 - protein, 34 aa, Artificial Sequence
  Description of Artificial Sequence: Synthetic polypeptide
  MOD_RES (13)..(13): 2-Abu
  C-term Amide
DCLGVMRKCDPDXDKCCRPNLVCSREHKWCKYVF

SEQ ID NO: 2860 - protein, 34 aa, Artificial Sequence
  Description of Artificial Sequence: Synthetic polypeptide
  MOD_RES (13)..(13): 2-Abu
  C-term Amide
DCLGLMRKCDPDXDKCCRPNLVCSREHKWCKYVF

SEQ ID NO: 2861 - protein, 34 aa, Artificial Sequence
  Description of Artificial Sequence: Synthetic polypeptide
  MOD_RES (13)..(13): 2-Abu
  C-term Amide
DCLGIMRKCDPDXDKCCRPNLVCSREHKWCKYVF

SEQ ID NO: 2862 - protein, 34 aa, Artificial Sequence
  Description of Artificial Sequence: Synthetic polypeptide
  MOD_RES (13)..(13): 2-Abu
  C-term Amide
DCLGGFRKCIPDXDKCCRPNLVCSREHKWCKYVF

SEQ ID NO: 2863 - protein, 34 aa, Artificial Sequence
  Description of Artificial Sequence: Synthetic polypeptide
  MOD_RES (13)..(13): 2-Abu
  C-term Amide
DCLGAFRKCIPDXDKCCRPNLVCSREHKWCKYVF

SEQ ID NO: 2864 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIPDXDKCCRPNLVCSREHKWCKYVF

SEQ ID NO: 2865 - protein, 34 aa, Artificial Sequence; identical to SEQ ID NO: 2864
  Description of Artificial Sequence: Synthetic polypeptide
  MOD_RES (5)..(5): Nva
  MOD_RES (13)..(13): 2-Abu
  C-term Amide

SEQ ID NO: 2866 - protein, 34 aa, Artificial Sequence; identical to SEQ ID NO: 2864
  Description of Artificial Sequence: Synthetic polypeptide
  MOD_RES (5)..(5): Nle
  MOD_RES (13)..(13): 2-Abu
  C-term Amide

SEQ ID NO: 2867 - protein, 34 aa, Artificial Sequence
  Description of Artificial Sequence: Synthetic polypeptide
  MOD_RES (13)..(13): 2-Abu
  C-term Amide
DCLGVFRKCIPDXDKCCRPNLVCSREHKWCKYVF

SEQ ID NO: 2868 - protein, 34 aa, Artificial Sequence
  Description of Artificial Sequence: Synthetic polypeptide
  MOD_RES (13)..(13): 2-Abu
  C-term Amide
DCLGLFRKCIPDXDKCCRPNLVCSREHKWCKYVF

SEQ ID NO: 2869 - protein, 34 aa, Artificial Sequence
  Description of Artificial Sequence: Synthetic polypeptide
  MOD_RES (13)..(13): 2-Abu
  C-term Amide
DCLGIFRKCIPDXDKCCRPNLVCSREHKWCKYVF

SEQ ID NO: 2870 - protein, 34 aa, Artificial Sequence
  Description of Artificial Sequence: Synthetic polypeptide
  MOD_RES (13)..(13): 2-Abu
  C-term Amide
DCLGGLRKCIPDXDKCCRPNLVCSREHKWCKYVF

SEQ ID NO: 2871 - protein, 34 aa, Artificial Sequence
  Description of Artificial Sequence: Synthetic polypeptide
  MOD_RES (13)..(13): 2-Abu
  C-term Amide
DCLGALRKCIPDXDKCCRPNLVCSREHKWCKYVF

SEQ ID NO: 2872 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIPDXDKCCRPNLVCSREHKWCKYVF

SEQ ID NO: 2873 - protein, 34 aa, Artificial Sequence; identical to SEQ ID NO: 2872
  Description of Artificial Sequence: Synthetic polypeptide
  MOD_RES (5)..(5): Nva
  MOD_RES (13)..(13): 2-Abu
  C-term Amide

SEQ ID NO: 2874 - protein, 34 aa, Artificial Sequence; identical to SEQ ID NO: 2872
  Description of Artificial Sequence: Synthetic polypeptide
  MOD_RES (5)..(5): Nle
  MOD_RES (13)..(13): 2-Abu
  C-term Amide

SEQ ID NO: 2875 - protein, 34 aa, Artificial Sequence
  Description of Artificial Sequence: Synthetic polypeptide
  MOD_RES (13)..(13): 2-Abu
  C-term Amide
DCLGVLRKCIPDXDKCCRPNLVCSREHKWCKYVF

SEQ ID NO: 2876 - protein, 34 aa, Artificial Sequence
  Description of Artificial Sequence: Synthetic polypeptide
  MOD_RES (13)..(13): 2-Abu
  C-term Amide
DCLGLLRKCIPDXDKCCRPNLVCSREHKWCKYVF

SEQ ID NO: 2877 - protein, 34 aa, Artificial Sequence
  Description of Artificial Sequence: Synthetic polypeptide
  MOD_RES (13)..(13): 2-Abu
  C-term Amide
DCLGILRKCIPDXDKCCRPNLVCSREHKWCKYVF

SEQ ID NO: 2878 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIPDXDKCCRPNLVCSREHKWCKYVF

SEQ ID NO: 2879 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIPDXDKCCRPNLVCSREHKWCKYVF

SEQ ID NO: 2880 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIPDXDKCCRPNLVCSREHKWCKYVF

SEQ ID NO: 2881 - protein, 34 aa, Artificial Sequence; identical to SEQ ID NO: 2880
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2882 - protein, 34 aa, Artificial Sequence; identical to SEQ ID NO: 2880
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2883 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIPDXDKCCRPNLVCSREHKWCKYVF

SEQ ID NO: 2884 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIPDXDKCCRPNLVCSREHKWCKYVF

SEQ ID NO: 2885 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIPDXDKCCRPNLVCSREHKWCKYVF

SEQ ID NO: 2886 - protein, 34 aa, Artificial Sequence; identical to SEQ ID NO: 2829
  Description of Artificial Sequence: Synthetic polypeptide
  MOD_RES (13)..(13): Pra
  C-term Amide

SEQ ID NO: 2887 - protein, 34 aa, Artificial Sequence; identical to SEQ ID NO: 2830
  Description of Artificial Sequence: Synthetic polypeptide
  MOD_RES (13)..(13): Pra
  C-term Amide

SEQ ID NO: 2888 - protein, 34 aa, Artificial Sequence; identical to SEQ ID NO: 2831
  Description of Artificial Sequence: Synthetic polypeptide
  MOD_RES (6)..(6): Nle
  MOD_RES (13)..(13): Pra
  C-term Amide

SEQ ID NO: 2889 - protein, 34 aa, Artificial Sequence; identical to SEQ ID NO: 2832
  Description of Artificial Sequence: Synthetic polypeptide
  MOD_RES (13)..(13): Pra
  C-term Amide

SEQ ID NO: 2890 - protein, 34 aa, Artificial Sequence; identical to SEQ ID NO: 2833
  Description of Artificial Sequence: Synthetic polypeptide
  MOD_RES (13)..(13): Pra
  C-term Amide

SEQ ID NO: 2891 - protein, 34 aa, Artificial Sequence; identical to SEQ ID NO: 2834
  Description of Artificial Sequence: Synthetic polypeptide
  MOD_RES (5)..(5): 2-Abu
  MOD_RES (13)..(13): Pra
  C-term Amide

SEQ ID NO: 2892 - protein, 34 aa, Artificial Sequence; identical to SEQ ID NO: 2834
  Description of Artificial Sequence: Synthetic polypeptide
  MOD_RES (5)..(5): Nva
  MOD_RES (13)..(13): Pra
  C-term Amide

SEQ ID NO: 2893 - protein, 34 aa, Artificial Sequence; identical to SEQ ID NO: 2834
  Description of Artificial Sequence: Synthetic polypeptide
  MOD_RES (5)..(5): Nle
  MOD_RES (13)..(13): Pra
  C-term Amide

SEQ ID NO: 2894 - protein, 34 aa, Artificial Sequence; identical to SEQ ID NO: 2837
  Description of Artificial Sequence: Synthetic polypeptide
  MOD_RES (13)..(13): Pra
  C-term Amide

SEQ ID NO: 2895 - protein, 34 aa, Artificial Sequence; identical to SEQ ID NO: 2838
  Description of Artificial Sequence: Synthetic polypeptide
  MOD_RES (13)..(13): Pra
  C-term Amide

SEQ ID NO: 2896 - protein, 34 aa, Artificial Sequence; identical to SEQ ID NO: 2839
  Description of Artificial Sequence: Synthetic polypeptide
  MOD_RES (13)..(13): Pra
  C-term Amide

SEQ ID NO: 2897 - protein, 34 aa, Artificial Sequence; identical to SEQ ID NO: 2840
  Description of Artificial Sequence: Synthetic polypeptide
  MOD_RES (13)..(13): Pra
  C-term Amide

SEQ ID NO: 2898 - protein, 34 aa, Artificial Sequence; identical to SEQ ID NO: 2841
  Description of Artificial Sequence: Synthetic polypeptide
  MOD_RES (13)..(13): Pra
  C-term Amide

SEQ ID NO: 2899 - protein, 34 aa, Artificial Sequence; identical to SEQ ID NO: 2842
  Description of Artificial Sequence: Synthetic polypeptide
  MOD_RES (6)..(6): Nle
  MOD_RES (13)..(13): Pra
  C-term Amide

SEQ ID NO: 2900 - protein, 34 aa, Artificial Sequence; identical to SEQ ID NO: 2843
  Description of Artificial Sequence: Synthetic polypeptide
  MOD_RES (13)..(13): Pra
  C-term Amide

SEQ ID NO: 2901 - protein, 34 aa, Artificial Sequence; identical to SEQ ID NO: 2844
  Description of Artificial Sequence: Synthetic polypeptide
  MOD_RES (13)..(13): Pra
  C-term Amide

SEQ ID NO: 2902 - protein, 34 aa, Artificial Sequence; identical to SEQ ID NO: 2845
  Description of Artificial Sequence: Synthetic polypeptide
  MOD_RES (5)..(5): 2-Abu
  MOD_RES (13)..(13): Pra
  C-term Amide

SEQ ID NO: 2903 - protein, 34 aa, Artificial Sequence; identical to SEQ ID NO: 2845
  Description of Artificial Sequence: Synthetic polypeptide
  MOD_RES (5)..(5): Nva
  MOD_RES (13)..(13): Pra
  C-term Amide

SEQ ID NO: 2904 - protein, 34 aa, Artificial Sequence; identical to SEQ ID NO: 2845
  Description of Artificial Sequence: Synthetic polypeptide
  MOD_RES (5)..(5): Nle
  MOD_RES (13)..(13): Pra
  C-term Amide

SEQ ID NO: 2905 - protein, 34 aa, Artificial Sequence; identical to SEQ ID NO: 2848
  Description of Artificial Sequence: Synthetic polypeptide
  MOD_RES (13)..(13): Pra
  C-term Amide

SEQ ID NO: 2906 - protein, 34 aa, Artificial Sequence; identical to SEQ ID NO: 2849
  Description of Artificial Sequence: Synthetic polypeptide
  MOD_RES (13)..(13): Pra
  C-term Amide

SEQ ID NO: 2907 - protein, 34 aa, Artificial Sequence; identical to SEQ ID NO: 2850
  Description of Artificial Sequence: Synthetic polypeptide
  MOD_RES (13)..(13): Pra
  C-term Amide

SEQ ID NO: 2908 - protein, 34 aa, Artificial Sequence; identical to SEQ ID NO: 2851
  Description of Artificial Sequence: Synthetic polypeptide
  MOD_RES (13)..(13): Pra
  C-term Amide

SEQ ID NO: 2909 - protein, 34 aa, Artificial Sequence; identical to SEQ ID NO: 2852
  Description of Artificial Sequence: Synthetic polypeptide
  MOD_RES (13)..(13): Pra
  C-term Amide

SEQ ID NO: 2910 - protein, 34 aa, Artificial Sequence; identical to SEQ ID NO: 2853
  Description of Artificial Sequence: Synthetic polypeptide
  MOD_RES (6)..(6): Nle
  MOD_RES (13)..(13): Pra
  C-term Amide

SEQ ID NO: 2911 - protein, 34 aa, Artificial Sequence; identical to SEQ ID NO: 2854
  Description of Artificial Sequence: Synthetic polypeptide
  MOD_RES (13)..(13): Pra
  C-term Amide

SEQ ID NO: 2912 - protein, 34 aa, Artificial Sequence; identical to SEQ ID NO: 2855
  Description of Artificial Sequence: Synthetic polypeptide
  MOD_RES (13)..(13): Pra
  C-term Amide

SEQ ID NO: 2913 - protein, 34 aa, Artificial Sequence; identical to SEQ ID NO: 2856
  Description of Artificial Sequence: Synthetic polypeptide
  MOD_RES (5)..(5): 2-Abu
  MOD_RES (13)..(13): Pra
  C-term Amide

SEQ ID NO: 2914 - protein, 34 aa, Artificial Sequence; identical to SEQ ID NO: 2856
  Description of Artificial Sequence: Synthetic polypeptide
  MOD_RES (5)..(5): Nva
  MOD_RES (13)..(13): Pra
  C-term Amide

SEQ ID NO: 2915 - protein, 34 aa, Artificial Sequence; identical to SEQ ID NO: 2856
  Description of Artificial Sequence: Synthetic polypeptide
  MOD_RES (5)..(5): Nle
  MOD_RES (13)..(13): Pra
  C-term Amide

SEQ ID NO: 2916 - protein, 34 aa, Artificial Sequence; identical to SEQ ID NO: 2859
  Description of Artificial Sequence: Synthetic polypeptide
  MOD_RES (13)..(13): Pra
  C-term Amide

SEQ ID NO: 2917 - protein, 34 aa, Artificial Sequence; identical to SEQ ID NO: 2860
  Description of Artificial Sequence: Synthetic polypeptide
  MOD_RES (13)..(13): Pra
  C-term Amide

SEQ ID NO: 2918 - protein, 34 aa, Artificial Sequence; identical to SEQ ID NO: 2861
  Description of Artificial Sequence: Synthetic polypeptide
  MOD_RES (13)..(13): Pra
  C-term Amide

SEQ ID NO: 2919 - protein, 34 aa, Artificial Sequence; identical to SEQ ID NO: 2862
  Description of Artificial Sequence: Synthetic polypeptide
  MOD_RES (13)..(13): Pra
  C-term Amide

SEQ ID NO: 2920 - protein, 34 aa, Artificial Sequence; identical to SEQ ID NO: 2863
  Description of Artificial Sequence: Synthetic polypeptide
  MOD_RES (13)..(13): Pra
  C-term Amide

SEQ ID NO: 2921 - protein, 34 aa, Artificial Sequence; identical to SEQ ID NO: 2864
  Description of Artificial Sequence: Synthetic polypeptide
  MOD_RES (5)..(5): 2-Abu
  MOD_RES (13)..(13): Pra
  C-term Amide

SEQ ID NO: 2922 - protein, 34 aa, Artificial Sequence; identical to SEQ ID NO: 2864
  Description of Artificial Sequence: Synthetic polypeptide
  MOD_RES (5)..(5): Nva
  MOD_RES (13)..(13): Pra
  C-term Amide

SEQ ID NO: 2923 - protein, 34 aa, Artificial Sequence; identical to SEQ ID NO: 2864
  Description of Artificial Sequence: Synthetic polypeptide
  MOD_RES (5)..(5): Nle
  MOD_RES (13)..(13): Pra
  C-term Amide

SEQ ID NO: 2924 - protein, 34 aa, Artificial Sequence; identical to SEQ ID NO: 2867
  Description of Artificial Sequence: Synthetic polypeptide
  MOD_RES (13)..(13): Pra
  C-term Amide

SEQ ID NO: 2925 - protein, 34 aa, Artificial Sequence; identical to SEQ ID NO: 2868
  Description of Artificial Sequence: Synthetic polypeptide
  MOD_RES (13)..(13): Pra
  C-term Amide

SEQ ID NO: 2926 - protein, 34 aa, Artificial Sequence; identical to SEQ ID NO: 2869
  Description of Artificial Sequence: Synthetic polypeptide
  MOD_RES (13)..(13): Pra
  C-term Amide

SEQ ID NO: 2927 - protein, 34 aa, Artificial Sequence; identical to SEQ ID NO: 2870
  Description of Artificial Sequence: Synthetic polypeptide
  MOD_RES (13)..(13): Pra
  C-term Amide

SEQ ID NO: 2928 - protein, 34 aa, Artificial Sequence; identical to SEQ ID NO: 2871
  Description of Artificial Sequence: Synthetic polypeptide
  MOD_RES (13)..(13): Pra
  C-term Amide

SEQ ID NO: 2929 - protein, 34 aa, Artificial Sequence; identical to SEQ ID NO: 2872
  Description of Artificial Sequence: Synthetic polypeptide
  MOD_RES (5)..(5): 2-Abu
  MOD_RES (13)..(13): Pra
  C-term Amide

SEQ ID NO: 2930 - protein, 34 aa, Artificial Sequence; identical to SEQ ID NO: 2872
  Description of Artificial Sequence: Synthetic polypeptide
  MOD_RES (5)..(5): Nva
  MOD_RES (13)..(13): Pra
  C-term Amide

SEQ ID NO: 2931 - protein, 34 aa, Artificial Sequence; identical to SEQ ID NO: 2872
  Description of Artificial Sequence: Synthetic polypeptide
  MOD_RES (5)..(5): Nle
  MOD_RES (13)..(13): Pra
  C-term Amide

SEQ ID NO: 2932 - protein, 34 aa, Artificial Sequence; identical to SEQ ID NO: 2875
  Description of Artificial Sequence: Synthetic polypeptide
  MOD_RES (13)..(13): Pra
  C-term Amide

SEQ ID NO: 2933 - protein, 34 aa, Artificial Sequence; identical to SEQ ID NO: 2876
  Description of Artificial Sequence: Synthetic polypeptide
  MOD_RES (13)..(13): Pra
  C-term Amide

SEQ ID NO: 2934 - protein, 34 aa, Artificial Sequence; identical to SEQ ID NO: 2877
  Description of Artificial Sequence: Synthetic polypeptide
  MOD_RES (13)..(13): Pra
  C-term Amide

SEQ ID NO: 2935 - protein, 34 aa, Artificial Sequence; identical to SEQ ID NO: 2878
  Description of Artificial Sequence: Synthetic polypeptide
  MOD_RES (6)..(6): Nle
  MOD_RES (13)..(13): Pra
  C-term Amide

SEQ ID NO: 2936 - protein, 34 aa, Artificial Sequence; identical to SEQ ID NO: 2879
  Description of Artificial Sequence: Synthetic polypeptide
  MOD_RES (6)..(6): Nle
  MOD_RES (13)..(13): Pra
  C-term Amide

SEQ ID NO: 2937 - protein, 34 aa, Artificial Sequence; identical to SEQ ID NO: 2880
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 2938 - protein, 34 aa, Artificial Sequence; identical to SEQ ID NO: 2880
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 2939 - protein, 34 aa, Artificial Sequence; identical to SEQ ID NO: 2880
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 2940 - protein, 34 aa, Artificial Sequence; identical to SEQ ID NO: 2883
  Description of Artificial Sequence: Synthetic polypeptide
  MOD_RES (6)..(6): Nle
  MOD_RES (13)..(13): Pra
  C-term Amide

SEQ ID NO: 2941 - protein, 34 aa, Artificial Sequence; identical to SEQ ID NO: 2884
  Description of Artificial Sequence: Synthetic polypeptide
  MOD_RES (6)..(6): Nle
  MOD_RES (13)..(13): Pra
  C-term Amide

SEQ ID NO: 2942 - protein, 34 aa, Artificial Sequence; identical to SEQ ID NO: 2885
  Description of Artificial Sequence: Synthetic polypeptide
  MOD_RES (6)..(6): Nle
  MOD_RES (13)..(13): Pra
  C-term Amide

SEQ ID NO: 2943 - protein, 34 aa, Artificial Sequence
  Description of Artificial Sequence: Synthetic polypeptide
  MOD_RES (13)..(13): 2-Abu
  C-term Amide
DCLGGFRKCIEDXDKCCRPNLVCSREHKWCKYVF

SEQ ID NO: 2944 - protein, 34 aa, Artificial Sequence
  Description of Artificial Sequence: Synthetic polypeptide
  MOD_RES (13)..(13): 2-Abu
  C-term Amide
DCLGAFRKCIEDXDKCCRPNLVCSREHKWCKYVF

SEQ ID NO: 2945 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCIEDXDKCCRPNLVCSREHKWCKYVF

SEQ ID NO: 2946 - protein, 34 aa, Artificial Sequence; identical to SEQ ID NO: 2945
  Description of Artificial Sequence: Synthetic polypeptide
  MOD_RES (5)..(5): Nva
  MOD_RES (13)..(13): 2-Abu
  C-term Amide

SEQ ID NO: 2947 - protein, 34 aa, Artificial Sequence; identical to SEQ ID NO: 2945
  Description of Artificial Sequence: Synthetic polypeptide
  MOD_RES (5)..(5): Nle
  MOD_RES (13)..(13): 2-Abu
  C-term Amide

SEQ ID NO: 2948 - protein, 34 aa, Artificial Sequence
  Description of Artificial Sequence: Synthetic polypeptide
  MOD_RES (13)..(13): 2-Abu
  C-term Amide
DCLGVFRKCIEDXDKCCRPNLVCSREHKWCKYVF

SEQ ID NO: 2949 - protein, 34 aa, Artificial Sequence
  Description of Artificial Sequence: Synthetic polypeptide
  MOD_RES (13)..(13): 2-Abu
  C-term Amide
DCLGLFRKCIEDXDKCCRPNLVCSREHKWCKYVF

SEQ ID NO: 2950 - protein, 34 aa, Artificial Sequence
  Description of Artificial Sequence: Synthetic polypeptide
  MOD_RES (13)..(13): 2-Abu
  C-term Amide
DCLGIFRKCIEDXDKCCRPNLVCSREHKWCKYVF

SEQ ID NO: 2951 - protein, 34 aa, Artificial Sequence
  Description of Artificial Sequence: Synthetic polypeptide
  MOD_RES (13)..(13): 2-Abu
  C-term Amide
DCLGGLRKCIEDXDKCCRPNLVCSREHKWCKYVF

SEQ ID NO: 2952 - protein, 34 aa, Artificial Sequence
  Description of Artificial Sequence: Synthetic polypeptide
  MOD_RES (13)..(13): 2-Abu
  C-term Amide
DCLGALRKCIEDXDKCCRPNLVCSREHKWCKYVF

SEQ ID NO: 2953 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCIEDXDKCCRPNLVCSREHKWCKYVF

SEQ ID NO: 2954 - protein, 34 aa, Artificial Sequence; identical to SEQ ID NO: 2953
  Description of Artificial Sequence: Synthetic polypeptide
  MOD_RES (5)..(5): Nva
  MOD_RES (13)..(13): 2-Abu
  C-term Amide

SEQ ID NO: 2955 - protein, 34 aa, Artificial Sequence; identical to SEQ ID NO: 2953
  Description of Artificial Sequence: Synthetic polypeptide
  MOD_RES (5)..(5): Nle
  MOD_RES (13)..(13): 2-Abu
  C-term Amide

SEQ ID NO: 2956 - protein, 34 aa, Artificial Sequence
  Description of Artificial Sequence: Synthetic polypeptide
  MOD_RES (13)..(13): 2-Abu
  C-term Amide
DCLGVLRKCIEDXDKCCRPNLVCSREHKWCKYVF

SEQ ID NO: 2957 - protein, 34 aa, Artificial Sequence
  Description of Artificial Sequence: Synthetic polypeptide
  MOD_RES (13)..(13): 2-Abu
  C-term Amide
DCLGLLRKCIEDXDKCCRPNLVCSREHKWCKYVF

SEQ ID NO: 2958 - protein, 34 aa, Artificial Sequence
  Description of Artificial Sequence: Synthetic polypeptide
  MOD_RES (13)..(13): 2-Abu
  C-term Amide
DCLGILRKCIEDXDKCCRPNLVCSREHKWCKYVF

SEQ ID NO: 2959 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCIEDXDKCCRPNLVCSREHKWCKYVF

SEQ ID NO: 2960 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCIEDXDKCCRPNLVCSREHKWCKYVF

SEQ ID NO: 2961 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCIEDXDKCCRPNLVCSREHKWCKYVF

SEQ ID NO: 2962 - protein, 34 aa, Artificial Sequence; identical to SEQ ID NO: 2961
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2963 - protein, 34 aa, Artificial Sequence; identical to SEQ ID NO: 2961
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2964 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCIEDXDKCCRPNLVCSREHKWCKYVF

SEQ ID NO: 2965 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCIEDXDKCCRPNLVCSREHKWCKYVF

SEQ ID NO: 2966 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCIEDXDKCCRPNLVCSREHKWCKYVF

SEQ ID NO: 2967 - protein, 34 aa, Artificial Sequence
  Description of Artificial Sequence: Synthetic polypeptide
  MOD_RES (13)..(13): 2-Abu
  C-term Amide
DCLGGFRKCEPDXDKCCRPNLVCSREHKWCKYVF

SEQ ID NO: 2968 - protein, 34 aa, Artificial Sequence
  Description of Artificial Sequence: Synthetic polypeptide
  MOD_RES (13)..(13): 2-Abu
  C-term Amide
DCLGAFRKCEPDXDKCCRPNLVCSREHKWCKYVF

SEQ ID NO: 2969 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCEPDXDKCCRPNLVCSREHKWCKYVF

SEQ ID NO: 2970 - protein, 34 aa, Artificial Sequence; identical to SEQ ID NO: 2969
  Description of Artificial Sequence: Synthetic polypeptide
  MOD_RES (5)..(5): Nva
  MOD_RES (13)..(13): 2-Abu
  C-term Amide

SEQ ID NO: 2971 - protein, 34 aa, Artificial Sequence; identical to SEQ ID NO: 2969
  Description of Artificial Sequence: Synthetic polypeptide
  MOD_RES (5)..(5): Nle
  MOD_RES (13)..(13): 2-Abu
  C-term Amide

SEQ ID NO: 2972 - protein, 34 aa, Artificial Sequence
  Description of Artificial Sequence: Synthetic polypeptide
  MOD_RES (13)..(13): 2-Abu
  C-term Amide
DCLGVFRKCEPDXDKCCRPNLVCSREHKWCKYVF

SEQ ID NO: 2973 - protein, 34 aa, Artificial Sequence
  Description of Artificial Sequence: Synthetic polypeptide
  MOD_RES (13)..(13): 2-Abu
  C-term Amide
DCLGLFRKCEPDXDKCCRPNLVCSREHKWCKYVF

SEQ ID NO: 2974 - protein, 34 aa, Artificial Sequence
  Description of Artificial Sequence: Synthetic polypeptide
  MOD_RES (13)..(13): 2-Abu
  C-term Amide
DCLGIFRKCEPDXDKCCRPNLVCSREHKWCKYVF

SEQ ID NO: 2975 - protein, 34 aa, Artificial Sequence
  Description of Artificial Sequence: Synthetic polypeptide
  MOD_RES (13)..(13): 2-Abu
  C-term Amide
DCLGGLRKCEPDXDKCCRPNLVCSREHKWCKYVF

SEQ ID NO: 2976 - protein, 34 aa, Artificial Sequence
  Description of Artificial Sequence: Synthetic polypeptide
  MOD_RES (13)..(13): 2-Abu
  C-term Amide
DCLGALRKCEPDXDKCCRPNLVCSREHKWCKYVF

SEQ ID NO: 2977 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCEPDXDKCCRPNLVCSREHKWCKYVF

SEQ ID NO: 2978 - protein, 34 aa, Artificial Sequence; identical to SEQ ID NO: 2977
  Description of Artificial Sequence: Synthetic polypeptide
  MOD_RES (5)..(5): Nva
  MOD_RES (13)..(13): 2-Abu
  C-term Amide

SEQ ID NO: 2979 - protein, 34 aa, Artificial Sequence; identical to SEQ ID NO: 2977
  Description of Artificial Sequence: Synthetic polypeptide
  MOD_RES (5)..(5): Nle
  MOD_RES (13)..(13): 2-Abu
  C-term Amide

SEQ ID NO: 2980 - protein, 34 aa, Artificial Sequence
  Description of Artificial Sequence: Synthetic polypeptide
  MOD_RES (13)..(13): 2-Abu
  C-term Amide
DCLGVLRKCEPDXDKCCRPNLVCSREHKWCKYVF

SEQ ID NO: 2981 - protein, 34 aa, Artificial Sequence
  Description of Artificial Sequence: Synthetic polypeptide
  MOD_RES (13)..(13): 2-Abu
  C-term Amide
DCLGLLRKCEPDXDKCCRPNLVCSREHKWCKYVF

SEQ ID NO: 2982 - protein, 34 aa, Artificial Sequence
  Description of Artificial Sequence: Synthetic polypeptide
  MOD_RES (13)..(13): 2-Abu
  C-term Amide
DCLGILRKCEPDXDKCCRPNLVCSREHKWCKYVF

SEQ ID NO: 2983 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCEPDXDKCCRPNLVCSREHKWCKYVF

SEQ ID NO: 2984 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCEPDXDKCCRPNLVCSREHKWCKYVF

SEQ ID NO: 2985 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCEPDXDKCCRPNLVCSREHKWCKYVF

SEQ ID NO: 2986 - protein, 34 aa, Artificial Sequence; identical to SEQ ID NO: 2985
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 2987 - protein, 34 aa, Artificial Sequence; identical to SEQ ID NO: 2985
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 2988 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCEPDXDKCCRPNLVCSREHKWCKYVF

SEQ ID NO: 2989 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCEPDXDKCCRPNLVCSREHKWCKYVF

SEQ ID NO: 2990 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCEPDXDKCCRPNLVCSREHKWCKYVF

SEQ ID NO: 2991 - protein, 34 aa, Artificial Sequence
  Description of Artificial Sequence: Synthetic polypeptide
  MOD_RES (13)..(13): 2-Abu
  C-term Amide
DCLGGFRKCDPDXDKCCRPNLVCSREHKWCKYVF

SEQ ID NO: 2992 - protein, 34 aa, Artificial Sequence
  Description of Artificial Sequence: Synthetic polypeptide
  MOD_RES (13)..(13): 2-Abu
  C-term Amide
DCLGAFRKCDPDXDKCCRPNLVCSREHKWCKYVF

SEQ ID NO: 2993 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXFRKCDPDXDKCCRPNLVCSREHKWCKYVF

SEQ ID NO: 2994 - protein, 34 aa, Artificial Sequence; identical to SEQ ID NO: 2993
  Description of Artificial Sequence: Synthetic polypeptide
  MOD_RES (5)..(5): Nva
  MOD_RES (13)..(13): 2-Abu
  C-term Amide

SEQ ID NO: 2995 - protein, 34 aa, Artificial Sequence; identical to SEQ ID NO: 2993
  Description of Artificial Sequence: Synthetic polypeptide
  MOD_RES (5)..(5): Nle
  MOD_RES (13)..(13): 2-Abu
  C-term Amide

SEQ ID NO: 2996 - protein, 34 aa, Artificial Sequence
  Description of Artificial Sequence: Synthetic polypeptide
  MOD_RES (13)..(13): 2-Abu
  C-term Amide
DCLGVFRKCDPDXDKCCRPNLVCSREHKWCKYVF

SEQ ID NO: 2997 - protein, 34 aa, Artificial Sequence
  Description of Artificial Sequence: Synthetic polypeptide
  MOD_RES (13)..(13): 2-Abu
  C-term Amide
DCLGLFRKCDPDXDKCCRPNLVCSREHKWCKYVF

SEQ ID NO: 2998 - protein, 34 aa, Artificial Sequence
  Description of Artificial Sequence: Synthetic polypeptide
  MOD_RES (13)..(13): 2-Abu
  C-term Amide
DCLGIFRKCDPDXDKCCRPNLVCSREHKWCKYVF

SEQ ID NO: 2999 - protein, 34 aa, Artificial Sequence
  Description of Artificial Sequence: Synthetic polypeptide
  MOD_RES (13)..(13): 2-Abu
  C-term Amide
DCLGGLRKCDPDXDKCCRPNLVCSREHKWCKYVF

SEQ ID NO: 3000 - protein, 34 aa, Artificial Sequence
  Description of Artificial Sequence: Synthetic polypeptide
  MOD_RES (13)..(13): 2-Abu
  C-term Amide
DCLGALRKCDPDXDKCCRPNLVCSREHKWCKYVF

SEQ ID NO: 3001 - protein, 34 aa, Artificial Sequence
  Description of Artificial Sequence: Synthetic polypeptide
  MOD_RES (5)..(5): 2-Abu
  MOD_RES (13)..(13): 2-Abu
  C-term Amide
DCLGXLRKCDPDXDKCCRPNLVCSREHKWCKYVF

SEQ ID NO: 3002 - protein, 34 aa, Artificial Sequence; identical to SEQ ID NO: 3001
  Description of Artificial Sequence: Synthetic polypeptide
  MOD_RES (5)..(5): Nva
  MOD_RES (13)..(13): 2-Abu
  C-term Amide

SEQ ID NO: 3003 - protein, 34 aa, Artificial Sequence; identical to SEQ ID NO: 3001
  Description of Artificial Sequence: Synthetic polypeptide
  MOD_RES (5)..(5): Nle
  MOD_RES (13)..(13): 2-Abu
  C-term Amide

SEQ ID NO: 3004 - protein, 34 aa, Artificial Sequence
  Description of Artificial Sequence: Synthetic polypeptide
  MOD_RES (13)..(13): 2-Abu
  C-term Amide
DCLGVLRKCDPDXDKCCRPNLVCSREHKWCKYVF

SEQ ID NO: 3005 - protein, 34 aa, Artificial Sequence
  Description of Artificial Sequence: Synthetic polypeptide
  MOD_RES (13)..(13): 2-Abu
  C-term Amide
DCLGLLRKCDPDXDKCCRPNLVCSREHKWCKYVF

SEQ ID NO: 3006 - protein, 34 aa, Artificial Sequence
  Description of Artificial Sequence: Synthetic polypeptide
  MOD_RES (13)..(13): 2-Abu
  C-term Amide
DCLGILRKCDPDXDKCCRPNLVCSREHKWCKYVF

SEQ ID NO: 3007 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGGXRKCDPDXDKCCRPNLVCSREHKWCKYVF

SEQ ID NO: 3008 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGAXRKCDPDXDKCCRPNLVCSREHKWCKYVF

SEQ ID NO: 3009 - protein, 34 aa, Artificial Sequence
  Description of Artificial Sequence: Synthetic polypeptide
  MOD_RES (5)..(5): 2-Abu
  MOD_RES (6)..(6): Nle
  MOD_RES (13)..(13): 2-Abu
  C-term Amide
DCLGXXRKCDPDXDKCCRPNLVCSREHKWCKYVF

SEQ ID NO: 3010 - protein, 34 aa, Artificial Sequence; identical to SEQ ID NO: 3009
  Description of Artificial Sequence: Synthetic polypeptide
  MOD_RES (5)..(5): Nva
  MOD_RES (6)..(6): Nle
  MOD_RES (13)..(13): 2-Abu
  C-term Amide

SEQ ID NO: 3011 - protein, 34 aa, Artificial Sequence; identical to SEQ ID NO: 3009
  Description of Artificial Sequence: Synthetic polypeptide
  MOD_RES (5)..(5): Nle
  MOD_RES (6)..(6): Nle
  MOD_RES (13)..(13): 2-Abu
  C-term Amide

SEQ ID NO: 3012 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGVXRKCDPDXDKCCRPNLVCSREHKWCKYVF

SEQ ID NO: 3013 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGLXRKCDPDXDKCCRPNLVCSREHKWCKYVF

SEQ ID NO: 3014 - protein, 34 aa, Artificial Sequence
  Description of Artificial Sequence: Synthetic polypeptide
  MOD_RES (6)..(6): Nle
  MOD_RES (13)..(13): 2-Abu
  C-term Amide
DCLGIXRKCDPDXDKCCRPNLVCSREHKWCKYVF

SEQ ID NO: 3015 - protein, 34 aa, Artificial Sequence; identical to SEQ ID NO: 2943
  Description of Artificial Sequence: Synthetic polypeptide
  MOD_RES (13)..(13): Pra
  C-term Amide

SEQ ID NO: 3016 - protein, 34 aa, Artificial Sequence; identical to SEQ ID NO: 2944
  Description of Artificial Sequence: Synthetic polypeptide
  MOD_RES (13)..(13): Pra
  C-term Amide

SEQ ID NO: 3017 - protein, 34 aa, Artificial Sequence; identical to SEQ ID NO: 2945
  Description of Artificial Sequence: Synthetic polypeptide
  MOD_RES (5)..(5): 2-Abu
  MOD_RES (13)..(13): Pra
  C-term Amide

SEQ ID NO: 3018 - protein, 34 aa, Artificial Sequence; identical to SEQ ID NO: 2945
  Description of Artificial Sequence: Synthetic polypeptide
  MOD_RES (5)..(5): Nva
  MOD_RES (13)..(13): Pra
  C-term Amide

SEQ ID NO: 3019 - protein, 34 aa, Artificial Sequence; identical to SEQ ID NO: 2945
  Description of Artificial Sequence: Synthetic polypeptide
  MOD_RES (5)..(5): Nle
  MOD_RES (13)..(13): Pra
  C-term Amide

SEQ ID NO: 3020 - protein, 34 aa, Artificial Sequence; identical to SEQ ID NO: 2948
  Description of Artificial Sequence: Synthetic polypeptide
  MOD_RES (13)..(13): Pra
  C-term Amide

SEQ ID NO: 3021 - protein, 34 aa, Artificial Sequence; identical to SEQ ID NO: 2949
  Description of Artificial Sequence: Synthetic polypeptide
  MOD_RES (13)..(13): Pra
  C-term Amide

SEQ ID NO: 3022 - protein, 34 aa, Artificial Sequence; identical to SEQ ID NO: 2950
  Description of Artificial Sequence: Synthetic polypeptide
  MOD_RES (13)..(13): Pra
  C-term Amide

SEQ ID NO: 3023 - protein, 34 aa, Artificial Sequence; identical to SEQ ID NO: 2951
  Description of Artificial Sequence: Synthetic polypeptide
  MOD_RES (13)..(13): Pra
  C-term Amide

SEQ ID NO: 3024 - protein, 34 aa, Artificial Sequence; identical to SEQ ID NO: 2952
  Description of Artificial Sequence: Synthetic polypeptide
  MOD_RES (13)..(13): Pra
  C-term Amide

SEQ ID NO: 3025 - protein, 34 aa, Artificial Sequence; identical to SEQ ID NO: 2953
  Description of Artificial Sequence: Synthetic polypeptide
  MOD_RES (5)..(5): 2-Abu
  MOD_RES (13)..(13): Pra
  C-term Amide

SEQ ID NO: 3026 - protein, 34 aa, Artificial Sequence; identical to SEQ ID NO: 2953
  Description of Artificial Sequence: Synthetic polypeptide
  MOD_RES (5)..(5): Nva
  MOD_RES (13)..(13): Pra
  C-term Amide

SEQ ID NO: 3027 - protein, 34 aa, Artificial Sequence; identical to SEQ ID NO: 2953
  Description of Artificial Sequence: Synthetic polypeptide
  MOD_RES (5)..(5): Nle
  MOD_RES (13)..(13): Pra
  C-term Amide

SEQ ID NO: 3028 - protein, 34 aa, Artificial Sequence; identical to SEQ ID NO: 2956
  Description of Artificial Sequence: Synthetic polypeptide
  MOD_RES (13)..(13): Pra
  C-term Amide

SEQ ID NO: 3029 - protein, 34 aa, Artificial Sequence; identical to SEQ ID NO: 2957
  Description of Artificial Sequence: Synthetic polypeptide
  MOD_RES (13)..(13): Pra
  C-term Amide

SEQ ID NO: 3030 - protein, 34 aa, Artificial Sequence; identical to SEQ ID NO: 2958
  Description of Artificial Sequence: Synthetic polypeptide
  MOD_RES (13)..(13): Pra
  C-term Amide

SEQ ID NO: 3031 - protein, 34 aa, Artificial Sequence; identical to SEQ ID NO: 2959
  Description of Artificial Sequence: Synthetic polypeptide
  MOD_RES (6)..(6): Nle
  MOD_RES (13)..(13): Pra
  C-term Amide

SEQ ID NO: 3032 - protein, 34 aa, Artificial Sequence; identical to SEQ ID NO: 2960
  Description of Artificial Sequence: Synthetic polypeptide
  MOD_RES (6)..(6): Nle
  MOD_RES (13)..(13): Pra
  C-term Amide

SEQ ID NO: 3033 - protein, 34 aa, Artificial Sequence; identical to SEQ ID NO: 2961
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 3034 - protein, 34 aa, Artificial Sequence; identical to SEQ ID NO: 2961
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 3035 - protein, 34 aa, Artificial Sequence; identical to SEQ ID NO: 2961
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 3036 - protein, 34 aa, Artificial Sequence; identical to SEQ ID NO: 2964
  Description of Artificial Sequence: Synthetic polypeptide
  MOD_RES (6)..(6): Nle
  MOD_RES (13)..(13): Pra
  C-term Amide

SEQ ID NO: 3037 - protein, 34 aa, Artificial Sequence; identical to SEQ ID NO: 2965
  Description of Artificial Sequence: Synthetic polypeptide
  MOD_RES (6)..(6): Nle
  MOD_RES (13)..(13): Pra
  C-term Amide

SEQ ID NO: 3038 - protein, 34 aa, Artificial Sequence; identical to SEQ ID NO: 2966
  Description of Artificial Sequence: Synthetic polypeptide
  MOD_RES (6)..(6): Nle
  MOD_RES (13)..(13): Pra
  C-term Amide

SEQ ID NO: 3039 - protein, 34 aa, Artificial Sequence; identical to SEQ ID NO: 2967
  Description of Artificial Sequence: Synthetic polypeptide
  MOD_RES (13)..(13): Pra
  C-term Amide

SEQ ID NO: 3040 - protein, 34 aa, Artificial Sequence; identical to SEQ ID NO: 2968
  Description of Artificial Sequence: Synthetic polypeptide
  MOD_RES (13)..(13): Pra
  C-term Amide

SEQ ID NO: 3041 - protein, 34 aa, Artificial Sequence; identical to SEQ ID NO: 2969
  Description of Artificial Sequence: Synthetic polypeptide
  MOD_RES (5)..(5): 2-Abu
  MOD_RES (13)..(13): Pra
  C-term Amide

SEQ ID NO: 3042 - protein, 34 aa, Artificial Sequence; identical to SEQ ID NO: 2969
  Description of Artificial Sequence: Synthetic polypeptide
  MOD_RES (5)..(5): Nva
  MOD_RES (13)..(13): Pra
  C-term Amide

SEQ ID NO: 3043 - protein, 34 aa, Artificial Sequence; identical to SEQ ID NO: 2969
  Description of Artificial Sequence: Synthetic polypeptide
  MOD_RES (5)..(5): Nle
  MOD_RES (13)..(13): Pra
  C-term Amide

SEQ ID NO: 3044 - protein, 34 aa, Artificial Sequence; identical to SEQ ID NO: 2972
  Description of Artificial Sequence: Synthetic polypeptide
  MOD_RES (13)..(13): Pra
  C-term Amide

SEQ ID NO: 3045 - protein, 34 aa, Artificial Sequence; identical to SEQ ID NO: 2973
  Description of Artificial Sequence: Synthetic polypeptide
  MOD_RES (13)..(13): Pra
  C-term Amide

SEQ ID NO: 3046 - protein, 34 aa, Artificial Sequence; identical to SEQ ID NO: 2974
  Description of Artificial Sequence: Synthetic polypeptide
  MOD_RES (13)..(13): Pra
  C-term Amide

SEQ ID NO: 3047 - protein, 34 aa, Artificial Sequence; identical to SEQ ID NO: 2975
  Description of Artificial Sequence: Synthetic polypeptide
  MOD_RES (13)..(13): Pra
  C-term Amide

SEQ ID NO: 3048 - protein, 34 aa, Artificial Sequence; identical to SEQ ID NO: 2976
  Description of Artificial Sequence: Synthetic polypeptide
  MOD_RES (13)..(13): Pra
  C-term Amide

SEQ ID NO: 3049 - protein, 34 aa, Artificial Sequence; identical to SEQ ID NO: 2977
  Description of Artificial Sequence: Synthetic polypeptide
  MOD_RES (5)..(5): 2-Abu
  MOD_RES (13)..(13): Pra
  C-term Amide

SEQ ID NO: 3050 - protein, 34 aa, Artificial Sequence; identical to SEQ ID NO: 2977
  Description of Artificial Sequence: Synthetic polypeptide
  MOD_RES (5)..(5): Nva
  MOD_RES (13)..(13): Pra
  C-term Amide

SEQ ID NO: 3051 - protein, 34 aa, Artificial Sequence; identical to SEQ ID NO: 2977
  Description of Artificial Sequence: Synthetic polypeptide
  MOD_RES (5)..(5): Nle
  MOD_RES (13)..(13): Pra
  C-term Amide

SEQ ID NO: 3052 - protein, 34 aa, Artificial Sequence; identical to SEQ ID NO: 2980
  Description of Artificial Sequence: Synthetic polypeptide
  MOD_RES (13)..(13): Pra
  C-term Amide

SEQ ID NO: 3053 - protein, 34 aa, Artificial Sequence; identical to SEQ ID NO: 2981
  Description of Artificial Sequence: Synthetic polypeptide
  MOD_RES (13)..(13): Pra
  C-term Amide

SEQ ID NO: 3054 - protein, 34 aa, Artificial Sequence; identical to SEQ ID NO: 2982
  Description of Artificial Sequence: Synthetic polypeptide
  MOD_RES (13)..(13): Pra
  C-term Amide

SEQ ID NO: 3055 - protein, 34 aa, Artificial Sequence; identical to SEQ ID NO: 2983
  Description of Artificial Sequence: Synthetic polypeptide
  MOD_RES (6)..(6): Nle
  MOD_RES (13)..(13): Pra
  C-term Amide

SEQ ID NO: 3056 - protein, 34 aa, Artificial Sequence; identical to SEQ ID NO: 2984
  Description of Artificial Sequence: Synthetic polypeptide
  MOD_RES (6)..(6): Nle
  MOD_RES (13)..(13): Pra
  C-term Amide

SEQ ID NO: 3057 - protein, 34 aa, Artificial Sequence; identical to SEQ ID NO: 2985
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 3058 - protein, 34 aa, Artificial Sequence; identical to SEQ ID NO: 2985
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 3059 - protein, 34 aa, Artificial Sequence; identical to SEQ ID NO: 2985
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 3060 - protein, 34 aa, Artificial Sequence; identical to SEQ ID NO: 2988
  Description of Artificial Sequence: Synthetic polypeptide
  MOD_RES (6)..(6): Nle
  MOD_RES (13)..(13): Pra
  C-term Amide

SEQ ID NO: 3061 - protein, 34 aa, Artificial Sequence; identical to SEQ ID NO: 2989
  Description of Artificial Sequence: Synthetic polypeptide
  MOD_RES (6)..(6): Nle
  MOD_RES (13)..(13): Pra
  C-term Amide

SEQ ID NO: 3062 - protein, 34 aa, Artificial Sequence; identical to SEQ ID NO: 2990
  Description of Artificial Sequence: Synthetic polypeptide
  MOD_RES (6)..(6): Nle
  MOD_RES (13)..(13): Pra
  C-term Amide

SEQ ID NO: 3063 - protein, 34 aa, Artificial Sequence; identical to SEQ ID NO: 2991
  Description of Artificial Sequence: Synthetic polypeptide
  MOD_RES (13)..(13): Pra
  C-term Amide

SEQ ID NO: 3064 - protein, 34 aa, Artificial Sequence; identical to SEQ ID NO: 2992
  Description of Artificial Sequence: Synthetic polypeptide
  MOD_RES (13)..(13): Pra
  C-term Amide

SEQ ID NO: 3065 - protein, 34 aa, Artificial Sequence; identical to SEQ ID NO: 2993
  Description of Artificial Sequence: Synthetic polypeptide
  MOD_RES (5)..(5): 2-Abu
  MOD_RES (13)..(13): Pra
  C-term Amide

SEQ ID NO: 3066 - protein, 34 aa, Artificial Sequence; identical to SEQ ID NO: 2993
  Description of Artificial Sequence: Synthetic polypeptide
  MOD_RES (5)..(5): Nva
  MOD_RES (13)..(13): Pra
  C-term Amide

SEQ ID NO: 3067 - protein, 34 aa, Artificial Sequence; identical to SEQ ID NO: 2993
  Description of Artificial Sequence: Synthetic polypeptide
  MOD_RES (5)..(5): Nle
  MOD_RES (13)..(13): Pra
  C-term Amide

SEQ ID NO: 3068 - protein, 34 aa, Artificial Sequence; identical to SEQ ID NO: 2996
  Description of Artificial Sequence: Synthetic polypeptide
  MOD_RES (13)..(13): Pra
  C-term Amide

SEQ ID NO: 3069 - protein, 34 aa, Artificial Sequence; identical to SEQ ID NO: 2997
  Description of Artificial Sequence: Synthetic polypeptide
  MOD_RES (13)..(13): Pra
  C-term Amide

SEQ ID NO: 3070 - protein, 34 aa, Artificial Sequence; identical to SEQ ID NO: 2998
  Description of Artificial Sequence: Synthetic polypeptide
  MOD_RES (13)..(13): Pra
  C-term Amide

SEQ ID NO: 3071 - protein, 34 aa, Artificial Sequence; identical to SEQ ID NO: 2999
  Description of Artificial Sequence: Synthetic polypeptide
  MOD_RES (13)..(13): Pra
  C-term Amide

SEQ ID NO: 3072 - protein, 34 aa, Artificial Sequence; identical to SEQ ID NO: 3000
  Description of Artificial Sequence: Synthetic polypeptide
  MOD_RES (13)..(13): Pra
  C-term Amide

SEQ ID NO: 3073 - protein, 34 aa, Artificial Sequence; identical to SEQ ID NO: 3001
  Description of Artificial Sequence: Synthetic polypeptide
  MOD_RES (5)..(5): 2-Abu
  MOD_RES (13)..(13): Pra
  C-term Amide

SEQ ID NO: 3074 - protein, 34 aa, Artificial Sequence; identical to SEQ ID NO: 3001
  Description of Artificial Sequence: Synthetic polypeptide
  MOD_RES (5)..(5): Nva
  MOD_RES (13)..(13): Pra
  C-term Amide

SEQ ID NO: 3075 - protein, 34 aa, Artificial Sequence; identical to SEQ ID NO: 3001
  Description of Artificial Sequence: Synthetic polypeptide
  MOD_RES (5)..(5): Nle
  MOD_RES (13)..(13): Pra
  C-term Amide

SEQ ID NO: 3076 - protein, 34 aa, Artificial Sequence; identical to SEQ ID NO: 3004
  Description of Artificial Sequence: Synthetic polypeptide
  MOD_RES (13)..(13): Pra
  C-term Amide

SEQ ID NO: 3077 - protein, 34 aa, Artificial Sequence; identical to SEQ ID NO: 3005
  Description of Artificial Sequence: Synthetic polypeptide
  MOD_RES (13)..(13): Pra
  C-term Amide

SEQ ID NO: 3078 - protein, 34 aa, Artificial Sequence; identical to SEQ ID NO: 3006
  Description of Artificial Sequence: Synthetic polypeptide
  MOD_RES (13)..(13): Pra
  C-term Amide

SEQ ID NO: 3079 - protein, 34 aa, Artificial Sequence; identical to SEQ ID NO: 3007
  Description of Artificial Sequence: Synthetic polypeptide
  MOD_RES (6)..(6): Nle
  MOD_RES (13)..(13): Pra
  C-term Amide

SEQ ID NO: 3080 - protein, 34 aa, Artificial Sequence; identical to SEQ ID NO: 3008
  Description of Artificial Sequence: Synthetic polypeptide
  MOD_RES (6)..(6): Nle
  MOD_RES (13)..(13): Pra
  C-term Amide

SEQ ID NO: 3081 - protein, 34 aa, Artificial Sequence; identical to SEQ ID NO: 3009
  Description of Artificial Sequence: Synthetic polypeptide
  MOD_RES (5)..(5): 2-Abu
  MOD_RES (6)..(6): Nle
  MOD_RES (13)..(13): Pra
  C-term Amide

SEQ ID NO: 3082 - protein, 34 aa, Artificial Sequence; identical to SEQ ID NO: 3009
  Description of Artificial Sequence: Synthetic polypeptide
  MOD_RES (5)..(5): Nva
  MOD_RES (6)..(6): Nle
  MOD_RES (13)..(13): Pra
  C-term Amide

SEQ ID NO: 3083 - protein, 34 aa, Artificial Sequence; identical to SEQ ID NO: 3009
  Description of Artificial Sequence: Synthetic polypeptide
  MOD_RES (5)..(5): Nle
  MOD_RES (6)..(6): Nle
  MOD_RES (13)..(13): Pra
  C-term Amide

SEQ ID NO: 3084 - protein, 34 aa, Artificial Sequence; identical to SEQ ID NO: 3012
  Description of Artificial Sequence: Synthetic polypeptide
  MOD_RES (6)..(6): Nle
  MOD_RES (13)..(13): Pra
  C-term Amide

SEQ ID NO: 3085 - protein, 34 aa, Artificial Sequence; identical to SEQ ID NO: 3013
  Description of Artificial Sequence: Synthetic polypeptide
  MOD_RES (6)..(6): Nle
  MOD_RES (13)..(13): Pra
  C-term Amide

SEQ ID NO: 3086 - protein, 34 aa, Artificial Sequence; identical to SEQ ID NO: 3014
  Description of Artificial Sequence: Synthetic polypeptide
  MOD_RES (6)..(6): Nle
  MOD_RES (13)..(13): Pra
  C-term Amide

SEQ ID NO: 3087 - protein, 448 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNFNYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPCVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3088 - protein, 214 aa, Artificial Sequence
  Description of Artificial Sequence: Synthetic polypeptide
DIQMTQSPSSVSASVGDRVTITCRASQGISRRLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3089 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPCVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3090 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3091 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3092 - protein, 330 aa, Homo sapiens [sequence omitted]

SEQ ID NO: 3093 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3094 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3095 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 3096 - protein, 106 aa, Homo sapiens
  C-term Amide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3097 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 3098 - protein, 106 aa, Homo sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

What is claimed is:

1. An isolated polypeptide comprising the amino acid sequence of the formula:

(SEQ ID NO: 476)

$X_{aa}{}^{1}X_{aa}{}^{2}Cys^{3}X_{aa}{}^{4}X_{aa}{}^{5}Ala^{6}X_{aa}{}^{7}X_{aa}{}^{8}X_{aa}{}^{9}Cys^{10}X_{aa}{}^{11}X_{aa}{}^{12}X_{aa}{}^{13}X_{aa}{}^{14}Asp^{15}$ $X_{aa}{}^{16}Cys^{17}Cys^{18}X_{aa}{}^{19}X_{aa}{}^{20}X_{aa}{}^{21}X_{aa}{}^{22}X_{aa}{}^{23}Cys^{24}X_{aa}{}^{25}X_{aa}{}^{26}X_{aa}{}^{27}X_{aa}{}^{28}$ $X_{aa}{}^{29}X_{aa}{}^{30}Cys^{31}Lys^{32}X_{aa}{}^{33}X_{aa}{}^{34}X_{aa}{}^{35}X_{aa}{}^{36}X_{aa}{}^{37}X_{aa}{}^{38}$ or a pharmaceutically acceptable salt thereof, wherein:

$X_{aa}{}^{1}$ and $X_{aa}{}^{2}$ are absent; or $X_{aa}{}^{1}$ is any amino acid residue and $X_{aa}{}^{2}$ is any amino acid residue; or $X_{aa}{}^{1}$ is absent and $X_{aa}{}^{2}$ is any amino acid residue;

$X_{aa}{}^{4}$ is an acidic, hydrophobic, basic, or neutral hydrophilic amino acid residue;

$X_{aa}{}^{5}$ is a Gly, Ala, hydrophobic, or basic amino acid residue;

$X_{aa}{}^{7}$ is a Gly, Ala, aromatic, or hydrophobic amino acid residue;

$X_{aa}{}^{8}$ is a basic, acidic, or neutral hydrophilic amino acid residue, or an Ala residue;

$X_{aa}{}^{9}$ is a basic or neutral hydrophilic amino acid residue;

$X_{aa}{}^{11}$ is any amino acid residue;

$X_{aa}{}^{12}$ is a Pro, acidic, neutral, or hydrophobic amino acid residue;

$X_{aa}{}^{13}$ is any amino acid residue;

$X_{aa}{}^{14}$ is any amino acid residue;

$X_{aa}{}^{16}$ is a basic, neutral hydrophilic, or acidic amino acid residue, or an Ala residue;

$X_{aa}{}^{19}$ is any amino acid residue;

$X_{aa}{}^{20}$ is a Pro, Gly, basic, or neutral hydrophilic residue;

$X_{aa}{}^{21}$ is a basic, hydrophobic, or neutral hydrophilic amino acid residue;

$X_{aa}{}^{22}$ is a hydrophobic or basic amino acid residue;

$X_{aa}{}^{23}$ is a hydrophobic, basic, or neutral hydrophilic amino acid residue;

$X_{aa}{}^{25}$ is a Ser, Ala, or a neutral hydrophilic amino acid residue;

$X_{aa}{}^{26}$ is an Ala, acidic, basic, or neutral hydrophilic amino acid residue;

$X_{aa}{}^{27}$ is an acidic, basic, neutral hydrophilic or hydrophobic residue;

$X_{aa}{}^{28}$ is an aromatic or basic amino acid residue;

$X_{aa}{}^{29}$ is an acidic, basic, or neutral hydrophilic amino acid residue;

$X_{aa}{}^{30}$ is a Trp, 5-bromoTrp, 6-bromoTrp, 5-chloroTrp, 6-chloroTrp, 1-Nal, 2-Nal, or thioTrp residue;

$X_{aa}{}^{33}$ is a hydrophobic or aromatic amino acid residue;

$X_{aa}{}^{34}$ is any amino acid residue;

$X_{aa}{}^{35}$ is a hydrophobic amino acid residue;

each of $X_{aa}{}^{36}$, $X_{m}{}^{37}$, and $X_{aa}{}^{38}$ is independently absent or is independently a neutral, basic, or hydrophobic amino acid residue; and wherein there is a disulfide bond between $Cys^{3}$ and $Cys^{18}$, a disulfide bond between $Cys^{10}$ and $Cys^{24}$, and a disulfide bond between $Cys^{17}$ and $Cys^{31}$.

2. The isolated polypeptide of claim 1, wherein $X_{aa}{}^{4}$ is selected from Ala, Glu, Asp, Phe, Pro, Ile, Leu, Met, Val, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, phosphoserine, phosphotyrosine, gamma-carboxyglutamic acid, and Cit residues.

3. The isolated polypeptide of claim 1, wherein $X_{aa}{}^{5}$ is selected from Ala, Phe, Ile, Leu, Met, Val, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues.

4. The isolated polypeptide of claim 1, wherein $X_{aa}{}^{7}$ is selected from Gly, Ala, Phe, Ile, Leu, Met, Val, Trp, Tyr, norleucine, norvaline, Pro, 2-pyridinylalanine, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues.

5. The isolated polypeptide of claim 1, wherein $X_{aa}{}^{8}$ is selected from Ala, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Ser, Thr, Asn, Gln, Cit, Asp, phosphoserine, phosphotyrosine, gamma-carboxyglutamic acid, and Glu residues.

6. The isolated polypeptide of claim 1, wherein $X_{aa}{}^{9}$ is selected from Ala, Pro, Met, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues.

7. The isolated polypeptide of claim 1, wherein $X_{aa}{}^{11}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

8. The isolated polypeptide of claim 1, wherein $X_{aa}^{12}$ is selected from alanine, valine, leucine, isoleucine, proline, serine, threonine, aspartic acid, glutamatic acid, glycine, norleucine, norvaline, 1-Nal, 2-Nal, 1'NMe-Trp, Cha, and 4-phenyl-phenylalanine (Bip), cyclohexylglycine (Chg), cyclohexylalanine (Cha), asparagine, glutamine, methionine, hydroxyproline, phenylalanine, tryptophan, and tyrosine.

9. The isolated polypeptide of claim 1, wherein $X_{aa}^{13}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

10. The isolated polypeptide of claim 1, wherein $X_{aa}^{14}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

11. The isolated polypeptide of claim 1, wherein $X_{aa}^{16}$ is selected from Ala, Pro, Met, Arg, Lys, His, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, Cit, Asp, phosphoserine, phosphotyrosine, gamma-carboxyglutamic acid, and Glu residues.

12. The isolated polypeptide of claim 1, wherein $X_{aa}^{19}$ is selected from Ala, Asp, Glu, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

13. The isolated polypeptide of claim 1, wherein $X_{aa}^{20}$ is selected from Ala, Gly, Pro, Met, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Gln, Asn, Ser, Thr, and Cit residues.

14. The isolated polypeptide of claim 1, wherein $X_{aa}^{21}$ is selected from Ala, Phe, Pro, Ile, Leu, Met, Val, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues.

15. The isolated polypeptide of claim 1, wherein $X_{aa}^{22}$ is selected from Ala, Phe, Ile, Leu, Met, Val, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, norleucine, norvaline, 1-Nal, 2-Nal, 1'NMe-Trp, cyclohexylglycine (Chg), cyclohexylalanine (Cha), and 4-phenyl-phenylalanine (Bip) residues.

16. The isolated polypeptide of claim 1, wherein $X_{aa}^{23}$ is selected from Ala, Phe, Pro, Ile, Leu, Met, Val, Trp, Tyr, Arg, Lys, His, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, cyclohexylglycine (Chg), cyclohexylalanine (Cha), glycine, norleucine, norvaline, 1-Nal, 2-Nal, 4-phenyl-phenylalanine (Bip), Gln, Asn, Ser, Thr, and Cit residues.

17. The isolated polypeptide of claim 1, wherein $X_{aa}^{25}$ is selected from Ala, Gly, Pro, Met, Gln, Asn, Ser, Thr, and Cit residues.

18. The isolated polypeptide of claim 1, wherein $X_{aa}^{26}$ is selected from Ala, Pro, Met, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, glycine, Glu, Asp, phosphoserine, phosphotyrosine, gamma-carboxyglutamic acid, Gln, Asn, Ser, Thr, and Cit residues.

19. The isolated polypeptide of claim 1, wherein $X_{aa}^{27}$ is selected from Thr, Leu, Ile, Val, Ser, Met, Gln, Asn, Phe, Tyr, Trp, norleucine, norvaline, 1-Nal, 2-Nal, cyclohexylglycine (Chg), cyclohexylalanine (Cha), 4-phenyl-phenylalanine (Bip), Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, Asp, Glu, phosphoserine, phosphotyrosine, gamma-carboxyglutamic acid, and Gly residues.

20. The isolated polypeptide of claim 1, wherein $X_{aa}^{28}$ is selected from Phe, Trp, Tyr, Arg, Lys, His, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, 1-Nal, 2-Nal, 2-pyridyl-alanine, 3-pyridyl-alanine, 4-pyridyl-alanine, 4-piperidinyl-alanine, and 4-phenyl-phenylalanine (Bip) residues.

21. The isolated polypeptide of claim 1, wherein $X_{aa}^{29}$ is selected from Ala, Asp, Glu, phosphoserine, phosphotyrosine, gamma-carboxyglutamic acid, Phe, Gly, His, Lys, Asn, Pro, Gln, Arg, Ser, Thr, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, and Dab residues.

22. The isolated polypeptide of claim 1, wherein $X_{aa}^{33}$ is selected from Phe, Ile, Leu, Met, Val, Trp, Tyr, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, 2-pyridyl-alanine, 3-pyridyl-alanine, 4-pyridyl-alanine, 4-piperidinyl-alanine, and 4-phenyl-phenylalanine (Bip) residues.

23. The isolated polypeptide of claim 1, wherein $X_{aa}^{34}$ is selected from Ala, Asp, Glu, Phe, Gly, His, Ile, Lys, Leu, Met, Asn, Pro, Gln, Arg, Ser, Thr, Val, Trp, Tyr, Pra, Atz, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, 2-pyridyl-alanine, 3-pyridyl-alanine, 4-carboxy-phenylalanine, and 4-phenyl-phenylalanine (Bip) residues.

24. The isolated polypeptide of claim 1, wherein $X_{aa}^{35}$ is selected from Phe, Ile, Leu, Met, Val, Trp, Tyr, norleucine, norvaline, 1-Nal, 2-Nal, 1'NMe-Trp, cyclohexylglycine (Chg), cyclohexylalanine (Cha), 2-chloro-phenylalanine, 4-chloro-phenylalanine, 3,4-dichlorophenylalanine, 4-trifluoromethyl-phenylalanine, and 4-phenyl-phenylalanine (Bip) residues.

25. The isolated polypeptide of claim 1, wherein each of $X_{aa}^{36}$, $X_{aa}^{37}$ and $X_{aa}^{38}$ is independently absent or is independently selected from Ala, Phe, Gly, His, Ile, Lys, Leu, Met, Asn, Pro, Gln, Arg, Ser, Thr, Val, Trp, Tyr, homolysine, ornithine, N-methyl-arginine, ω-aminoarginine, ω-methyl-arginine, 1-methyl-histidine, 3-methyl-histidine, homoarginine, N-methyl-lysine, N-ϵ-methyl lysine, Dab, norleucine, norvaline, 1-Nal, 2-Nal, cyclohexylglycine (Chg), cyclohexylalanine (Cha), and 4-phenyl-phenylalanine (Bip) residues.

26. The isolated polypeptide of claim 1, wherein the carboxy-terminal residue is amidated.

27. The isolated polypeptide of claim 1, wherein $X_{aa}^{27}$ is Glu.

28. The isolated polypeptide of claim 1, wherein $X_{aa}^{29}$ is Asp, Glu, or Gln.

29. The isolated polypeptide of claim 1, comprising an amino acid sequence selected from SEQ ID NOS: 22, 252-263, 419-432, 435, 436, 438, 439, 518-521, 524, 525, 562-576, 578, 579, 580, 602, 691, 692, 696-703, 715, 721-735, 737-749, 756, 757, 761, 762, 764-771, 787, 788, 790-796, 798, 800, 802, 803, 809-812, 1028, 1030-1040, 1043-1047, 1062-1065, and 1068-1070.

30. The isolated polypeptide of claim 1, comprising an amino acid sequence selected from SEQ ID NOS: 1082, 1096, 1110, 1124, 1135, 1146, 1157, 1165, 1173, 1181, 1192, 1203, 1214, 1222, 1230, 1238, 1249, 1260, 1271, 1279, 1287, 1295, 1306, 1317, 1328, 1336, 1344, 1352, 1360, 1368, 1376, 1384, 1392, 1400, 1408, 1416, 1424, 1432, 1440, 1448, 1456, 1464, 1472, 1480, 1488, 1496, 1504, 1512, 1520, 1528, 1536, 1544, 1552, 1560, 1568, 1576, 1584, 1592, 1600, 1608, 1616, 1624, 1632, 1640, 1658, 1672, 1686, 1700, 1711, 1722, 1733, 1741, 1749, 1757, 1768, 1779, 1790, 1798, 1806, 1814, 1825, 1836, 1847, 1855, 1863, 1871, 1882, 1893, 1904, 1912, 1920, 1928, 1936, 1944, 1952, 1960, 1968, 1976, 1984, 1992, 2000, 2008, 2016, 2024, 2032, 2040, 2048, 2056, 2064, 2072, 2080, 2088, 2096, 2104, 2112, 2120, 2128, 2136, 2144, 2152, 2160, 2168, 2176, 2184, 2192, 2200, 2208, 2216, 2234, 2248, 2262, 2276, 2287, 2298, 2309, 2317, 2325, 2333, 2344, 2355, 2366, 2374, 2382, 2390, 2401, 2412, 2423, 2431, 2439, 2447, 2458, 2469, 2480, 2488, 2496, 2504, 2512, 2520, 2528, 2536, 2544, 2552, 2560, 2568, 2576, 2584, 2592, 2600, 2608, 2616, 2624, 2632, 2640, 2648, 2656, 2664, 2672, 2680, 2688, 2696, 2704, 2712, 2720, 2728, 2736, 2744, 2752, 2760, 2768, 2776, 2784, 2792, 2808, 2822, 2833, 2844, 2855, 2863, 2871, 2879, 2890, 2901, 2912, 2920, 2928, 2936, 2944, 2952, 2960, 2968, 2976, 2984, 2992, 3000, 3008, 3016, 3024, 3032, 3040, 3048, 3056, 3064, 3072, and 3080.

31. The isolated polypeptide of claim 1, comprising an amino acid sequence selected from SEQ ID NOS: 597-601 and 813-1027.

32. The isolated polypeptide of claim 1, comprising an amino acid sequence selected from SEQ ID NOS: 22, 262, 640, 1028, 1031, 1035, and 1046-1048.

33. The isolated polypeptide of claim 1, wherein the polypeptide is covalently linked to a half-life extending moiety.

34. The isolated polypeptide of claim 33, wherein the half-life extending moiety is polyethylene glycol of molecular weight of about 1000 Da to about 100000 Da, an IgG Fc domain, a transthyretin, or a human serum albumin.

35. The isolated polypeptide of claim 33, wherein the half-life extending moiety comprises a human immunoglobulin or a human immunoglobulin Fc domain, or both.

36. The isolated polypeptide of claim 35, wherein the polypeptide is covalently linked to an immunoglobulin or immunoglobulin Fc domain to form a monovalent immunoglobulin-peptide or Fc-peptide conjugate.

37. The isolated polypeptide of claim 35, wherein two copies of the polypeptide are covalently linked to an immunoglobulin or immunoglobulin Fc domain to form a bivalent immunoglobulin-peptide or Fc-peptide conjugate.

38. The isolated polypeptide of claim 1, wherein $X_{aa}^{29}$ is an acidic or neutral hydrophilic residue.

39. The isolated polypeptide of claim 38, wherein $X_{aa}^{29}$ is selected from Ala, Asp, Glu, Gly, Asn, Gln, Ser, Thr, phosphoserine, phosphotyrosine, and gamma-carboxyglutamic acid residues.

40. A pharmaceutical composition, comprising the isolated polypeptide of claim 1, and a pharmaceutically acceptable carrier.

* * * * *